US007994398B2

(12) United States Patent
Dhugga et al.

(10) Patent No.: US 7,994,398 B2
(45) Date of Patent: Aug. 9, 2011

(54) SECONDARY WALL FORMING GENES FROM MAIZE AND USES THEREOF

(75) Inventors: Kanwarpal S Dhugga, Johnston, IA (US); Robert B Meeley, Des Moines, IA (US); Carl R Simmons, Des Moines, IA (US)

(73) Assignee: Pioneer Hi-Bred International, Inc., Johnston, IA (US)

( * ) Notice: Subject to any disclaimer, the term of this patent is extended or adjusted under 35 U.S.C. 154(b) by 425 days.

(21) Appl. No.: 12/138,475

(22) Filed: Jun. 13, 2008

(65) Prior Publication Data

US 2008/0313777 A1 Dec. 18, 2008

Related U.S. Application Data

(60) Provisional application No. 60/944,117, filed on Jun. 15, 2007.

(51) Int. Cl.
C12N 15/82 (2006.01)
C12N 15/63 (2006.01)
C12N 15/09 (2006.01)
A01H 5/00 (2006.01)
A01H 5/10 (2006.01)

(52) U.S. Cl. ........ 800/290; 800/278; 800/284; 800/295; 435/320.1; 435/468; 536/23.1; 536/23.2; 536/23.6

(58) Field of Classification Search .......................... None
See application file for complete search history.

(56) References Cited

U.S. PATENT DOCUMENTS

| 2004/0123343 | A1* | 6/2004 | La Rosa et al. ............... 800/278 |
| 2006/0048240 | A1 | 3/2006 | Alexandrov et al. |
| 2006/0141495 | A1 | 6/2006 | Wu |

FOREIGN PATENT DOCUMENTS

| EP | 1 586 645 A2 | 10/2005 |
| WO | 2005012516 A2 | 2/2005 |
| WO | 2006041770 A1 | 4/2006 |

OTHER PUBLICATIONS

Desprez et al 2007 PNAS 104:15572-15577.*
Appenzeller, L., et al.; "Cellulose synthases in maize: isolation and expression analysis of the cellulose synthase (CesA) gene family"; Cellulose (2004) 11:287-299; Kluwer Academic Publishers; The Netherlands.
Aspeborg, H., et al.; "Carbohydrate-Active Enzymes Involved in the Secondary Cell Wall Biogenesis in Hybrid Aspen"; Plant Physiology (Mar. 2005) 137:983-997; American Society of Plant Biologists; Rockville, MD, US.
Ching, A., et al.; "Brittle stalk 2 encodes a putative glycosylphosphatidylinositol-anchored protein that affects mechanical strength of maize tissues by altering the composition and structure of secondary cell walls"; Planta (2006) 224:1174-1184; Springer-Verlag; Berlin/Heidelberg, Germany.
Li, Y., et al.; "BRITTLE CULM1, Which Encodes a COBRA-Like Protein, Affects the Mechanical Properties of Rice Plants"; The Plant Cell (Sep. 2003) 15:2020-2031; American Society of Plant Physiologists; Rockville, MD, US.
Ma, J., et al.; "ZMMBH Sequences" CL987600 Sep. 2004.
Taylor, N., et al.; "Multiple Cellulose Synthase Catalytic Subunits Are Required for Cellulose Synthesis in *Arabidopsis*" The Plant Cell (Dec. 2000) 12:2529-2539; American Society of Plant Physiologists; Rockville, MD, US.
Zhong, R., et al.; "Expression of a Mutant Form of Cellulose Synthase AtCesA7 Causes Dominant Negative Effect on Cellulose Biosynthesis"; Plant Physiology (Jun. 2003) 132:786-795; American Society of Plant Biologists; Rockville, MD, US.
Zhong, R., et al.; "A batter of transcription factors involved in the regulation of secondary cell wall biosynthesis in *Arabidopsis*"; Plant Cell (2008) 20(10):2763-2782; American Society of Plant Physiologists; Rockville, MD US.
Creux, N.M., et al.; "Copmarative analysis of orthologous cellulose synthase promoters from *Arabidopsis, Populus* and *Eucalyptus*: Evidence of conserved regulatory elements in angiospersms"; New Phytologist (2008) 179(3):722-737; John Wiley & Sons; Hoboken, NJ, US.
Liu, D., et al.; "Genes encoding fasciclin-like arabinogalactan proteins are specifically expressed during cotton fiber development"; Plant Molecular Biology Reporter (2008) 26(2):98-113; Springer; The Netherlands.
Mellerowicz, E.J., et al.; "Wood cell walls: biosynthesis, developmental dynamics and their implications for wood properties"; Current Opinion in Plant Biology (2008) 11(3):293-300; Elsevier Ltd.; Oxford, UK.
Wightman, R., et al.; "The roles of the cytoskeleton during cellulose deposition at the secondary cell wall"; Plant Journal (2008) 54(5):794-805; Blackwell Publishing Ltd.; Oxford, UK.
York, W.S., et al.; "Biochemical control of xylan biosynthesis—which end is up?" Current Opinion in Plant Biology (2008) 11(3):258-265; Elsevier Ltd.; Oxford, UK.
Chavez Montes, R.A., et al.; "Cell wall modifications in *Arabidopsis* plants with altered delta-L-Arabinofuranosidase Activity"; Plant Physiology (2008) 147(1):63-67; American Society of Plant Biologists; Rockville, MD, US.
Endo, S., et al.; "Transient transformation and RNA silencing in *Zinnia* tracheary element differentiating cell cultures"; Plant Journal (2008) 53(5):864-875; Blackwell Publishing Ltd.; Oxford, UK.
Zhao, C., et al.; "XND1, a member of the NAC domain family in *Arabidopsis thaliana*, negatively regulates lignocellulose synthesis and programmed cell death in xylem"; Plant Journal (2008) 53(3):425-436; Blackwell Publishing Ltd.; Oxford, UK.
Hovav, R., et al.; "A majority of cotton genes are expressed in single-celled fiber"; Planta (2008) 227(2):319-329; Springer-Verlag; Berlin/Heidelberg, Germany.
Yoshinaga, A., et al.; "Modified lignification in the cell walls of CAD depressed poplars" IAWA Journal (2007) 28(4):457-471.

(Continued)

Primary Examiner — Brent T Page

(57) ABSTRACT

The present invention provides polynucleotides and related polypeptides of the class of genes involved in maize secondary wall (ZmSCW) formation. The invention provides genomic sequence for the ZmSCW genes. ZmSCW are responsible for controlling plant growth, secondary cell wall development and yield in crop plants.

27 Claims, 3 Drawing Sheets

OTHER PUBLICATIONS

Lee, C., et al.; "The PARVUS gene is expressed in cells undergoing secondary wall thickening and is essential for glucuronoxylan biosynthesis"; Plant and Cell Physiology (2007) 48(12):1659-1672; Oxford University Press; Oxford, UK.

Lee, J.J., et al.; "Gene expression changes and early events in cotton fibre development"; Annals of Botany (2007) 100(7):1391-1401; Oxford University Press; Oxford, UK.

Sindhu, A., et al.; "Maize Brittle stalk2 encodes a COBRA-like protein expressed in early organ development but required for tissue flexibility at maturity"; Plant Physiology (2007) 145(4):1444-1459; American Society of Plant Biologists; Rockville, MD, US.

Zhong, R., et al.; "Regulation of cell wall biosynthesis"; Current Opinion in Plant Biology (2007) 10(6):564-572; Elsevier, Inc.; Amsterdam, The Netherlands.

Bindschedler, L.V., et al. "Modification of hemicellulose content by antisense down-regulation of UDP-glucuronate decarboxylase in tobacco and its consequences for cellulose extractability"; Phytochemistry (2007) 68(21):2635-2648; Elseiver; Amsterdam, The Netherlands.

Zhong, R., et al.; "The MYB46 transcription factor is a direct target of SND1 and regulates secondary wall biosynthesis in *Arabidopsis*" Plant Cell (2007) 19(9):2776-2792; American Society of Plant Physiologists; Rockville, MD US.

Oikawa, A., et al.; "Virus-induced gene silencing of P23k in barley leaf reveals morphological changes involved in secondary wall transformation"; Journal of Experimental Botany (2007) 58(10):2617-2625; Oxford University Press; Oxford, UK.

Zhou, J.J., et al.; "Alteration in secondary wall deposition by overexpression of the fragile fiber1 kinesin-like protein in *Arabidopsis*"; Journal of Integrative Plant Biology (2007) 49(8):1235-1243.

Ko, J.H., et al.; "ANAC012, a member of the plant-specific NAC transcription factor family, negatively regulates xylary fiber development in *Arbidopsis thaliana*"; Plant Journal (2007) 50(6):1035-1048; Blackwell Publishing Ltd; Oxford, UK.

Nishikubo, N., et al.; "Xyloglucan endo-transglycosylase (XET) functions in gelatinous layers of tension wood fibers in poplar—A glimpse into the mechanism of the balancing act of trees"; Plant and Cell Physiology (2007) 48(6):843-855; Oxford University Press; Oxford, UK.

Zhong, R., et al.; "Two NAC domain transcription factors, SND1 and NST1, function redundantly in regulation of secondary wall synthesis in fibers of *Arabidopsis*"; Planta (2007) 225(6):1603-1611; Springer-Verlag; Berlin/Heidelberg, Germany.

Zhou, G.K., et al.; "Molecular characterization of PoGT8D and PoGT43B, two secondary wall-associated glycosyltransferases in poplar"; Plant and Cell Physiology (2007) 48(5):689-699; Oxford University Press; Oxford, UK.

Yang, C., et al.; "*Arabdiopsis* MYB26/MALE STERILE35 regulates secondary thickening in the endothecium and is essential for anther dehiscence"; Plant Cell (2007) 19(2):534-548; American Society of Plant Physiologists; Rockville, MD, US.

Pena, M.J., et al.; "*Arabdiopsis* irregular xylem8 and irregular xylem9: Implications for the complexity of glucuronoxylan biosynthesis"; Plant Cell (2007) 19(2):549-563; American Society of Plant Physiologists; Rockville, MD, US.

Mitsuda, N., et al.; "NAC transcription factors, NST1 and NST3, are key regulators of the formation of secondary walls in woody tissues of *Arabidopsis*"; Plant Cell (2007) 19(1):270-280; American Society of Plant Physiologists; Rockville, MD, US.

Zhong, R., et al.; "SND1, a NAC domain transcription factor, is a key regulator of secondary wall synthesis in fibers of *Arabidopsis*"; Plant Cell (2006) 18(11):3158-3170; American Society of Plant Physiologists; Rockville, MD, US.

Ching, A., et al.; "Brittle Stalk 2 encodes a putative glycosylphosphatidylinositol-anchored protein that affects mechanical strength of maize tissues by altering the composition and structure of secondary cell walls"; Planta (2006) 224(5):1174-1184; Springer-Verlag; Berlin/Heidelberg, Germany.

Bhandari, S., et al.; "Xylem-specific and tension stress-responsive coexpression of KORRIGAN endoglucanase and three secondary wall-associated cellulose synthase genes in aspen trees"; Planta (2006) 224(4):828-837; Springer-Verlag; Berlin/Heidelberg, Germany.

* cited by examiner

SECONDARY WALL FORMING GENES FROM MAIZE AND USES THEREOF

CROSS REFERENCE

This utility application claims the benefit U.S. Provisional Application No. 60/944,117, filed Jun. 15, 2007 which is incorporated herein by reference.

FIELD OF THE INVENTION

The invention relates generally to the field of molecular biology.

BACKGROUND OF THE INVENTION

Harvest index, ratio of grain to total aboveground biomass, has remained nearly constant around 50% in maize over the past 100 years. (Sinclair, (1998) "Historical changes in harvest index and crop nitrogen accumulation"; *Crop Science* 38:638-643); (Tollenaar and Wu. (1999) "Yield improvement in temperate maize is attributable to greater stress tolerance"; *Crop Science* 39:1597-1604). Thus, the quadrupling of grain yield over the last 50-60 years has resulted from an increase in total biomass production per unit land area, which has been accomplished by increased planting density (Duvick and Cassman, (1999) "Post-green revolution trends in yield potential of temperate maize in the north-central United States"; *Crop Science* 39:1622-1630). Selection for higher grain yield under increasing planting densities has led to a significant architectural change in plant structure, that of relatively erect and narrow leaves to minimize shading. An undesirable consequence of denser planting has been the increased frequency of stalk lodging. The relationship between planting density and biomass production deviates significantly from linearity as the optimal density is approached for maximal biomass yield per unit land area. This is reflected in a proportionately greater reduction in the individual plant biomass, which manifests in the form of weaker stalks and hence increased lodging.

Cellulose in a unit length of the maize stalk was found to be the best indicator of mechanical strength (Appenzeller, et al., (2004) "Cellulose synthesis in maize: isolation and expression analysis of the cellulose synthase (CesA) gene family"; *Cellulose* 11:287-299; Ching, et al., (2006) "Brittle stalk 2 encodes a putative glycosylphosphatidylinositol-anchored protein that affects mechanical strength of maize tissues by altering the composition and structure of secondary cell walls"; *Planta* 224:1174-1184). Cellulose constitutes approximately 50% of the stalk dry matter at maturity (Dhugga, unpublished). Whereas the concentration of cellulose in the maize stalk wall can vary considerably in the germplasm that for lignin is essentially invariable (Dhugga, unpublished). This implies that the concentration of cellulose varies at the expense of other cell wall components such as hemicellulose and soluble components. Increasing cellulose concentration in the dry matter should allow improving harvest index without adversely affecting stalk mechanical strength. Thus the most preferred means of improving stalk strength are through increased cellulose concentration and secondary wall content.

This invention pertains to a set of maize genes involved in cell wall formation, in particular secondary cell wall formation (SCW). Cellulose may constitute up to 60% of the secondary cell wall of plants such as maize. The genes that are subject of this invention are revealed to be associated with secondary cell wall formation based on the strong correlation of their expression patterns with those of ZmCesA10, ZmCesA11, ZmCesA12, ZmCesA13, and Bk2 genes that had previously been shown to be involved in secondary cell wall formation (Appenzeller, et al., (2004) "Cellulose synthesis in maize: isolation and expression analysis of the cellulose synthase (CesA) gene family"; *Cellulose* 11:287-299; Ching, et al., (2006) "Brittle stalk 2 encodes a putative glycosylphosphatidylinositol-anchored protein that affects mechanical strength of maize tissues by altering the composition and structure of secondary cell walls"; *Planta* 224:1174-1184; Dhugga, unpublished). Many of the genes in this invention are not known to be associated with cell wall formation outside of these proprietary analyses. These genes could be used to enhance crop plant performance and value in several areas including: 1) plant standability, harvest index, and yield potential; 2) plant dry matter as a feedstock for ethanol or for other renewable bioproducts; and 3) silage.

In addition to its role as the primary determinant of tissue strength, a trait that is of significant interest in agriculture, cellulose constitutes the most abundant renewable energy resource on Earth. Approximately 275 million metric tons of stover is produced just from maize in the USA every year. About two-thirds of stover could potentially be utilized for ethanol, butanol and other fuels or bioproducts from some corn-growing regions (Graham, et al., (2007) "Current and potential U.S. corn stover supplies"; *Agronomy Journal* 99:1-11). The worldwide production of lignocellulosic wastes from cereal stover and straw is estimated to be ~3 billion tons per year (Kuhad and Singh (1993) "Lignocellulose biotechnology: Current and future prospects"; *Critic. Rev. Biotechnol.* 13:151-172). Secondary wall accounts for a great majority of the vegetative biomass in the terrestrial vegetation and is thus a suitable target for manipulation to improve the amount and quality of biomass for energy production. Alteration of secondary wall for improved silage quality may be accomplished by altering lignin concentration. Both the type and amount of lignin have long been known to affect silage digestibility. Lignin is also an impediment in the digestion of cell wall polysaccharides for ethanol production. Several of the genes in our list expand the number of candidates we can use to alter the composition of cell wall for improved silage quality.

This invention provides solutions to agronomic problems in at least three areas: 1) plant standability, harvest index, and yield potential; 2) plant dry matter as a feedstock for ethanol or for other renewable bioproducts; and 3) silage digestibility.

BRIEF SUMMARY OF THE INVENTION

Compositions and methods for controlling plant growth and secondary cell wall formation for increasing yield in a plant are provided. The compositions include SCW sequences from maize. Compositions of the invention comprise amino acid sequences and nucleotide sequences selected from SEQ ID NOS: 1-456 as well as variants and fragments thereof.

Polynucleotides encoding the SCW sequences are provided in DNA constructs for expression in a plant of interest. Expression cassettes, plants, plant cells, plant parts, and seeds comprising the sequences of the invention are further provided. In specific embodiments, the polynucleotide is operably linked to a constitutive promoter.

Methods for modulating the level of an SCW sequence in a plant or plant part are provided. The methods comprise introducing into a plant or plant part a heterologous polynucleotide comprising an SCW sequence of the invention. The level of SCW polypeptide can be increased or decreased.

Such method can be used to increase the yield in plants; in one embodiment, the method is used to increase grain yield in cereals.

DETAILED DESCRIPTION OF THE INVENTION

Figure 1:
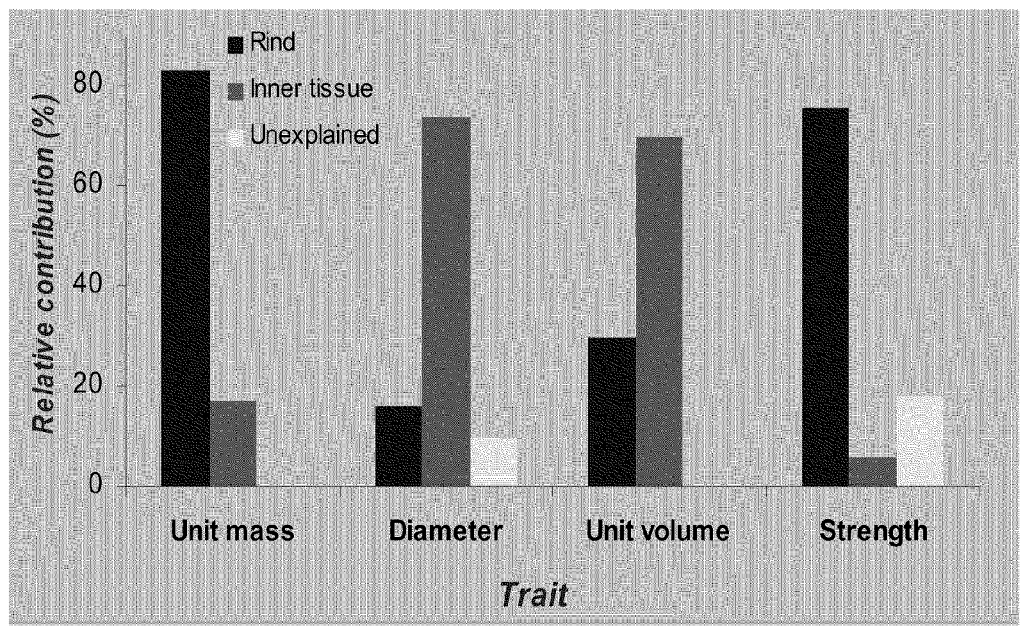
FIG. 1: Relative contribution of maize stalk rind and inner tissue to different stalk characteristics and mechanical strength.

Unless defined otherwise, all technical and scientific terms used herein have the same meaning as commonly understood by one of ordinary skill in the art to which this invention belongs. Unless mentioned otherwise, the techniques employed or contemplated herein are standard methodologies well known to one of ordinary skill in the art. The materials, methods and examples are illustrative only and not limiting. The following is presented by way of illustration and is not intended to limit the scope of the invention.

The present inventions now will be described more fully hereinafter with reference to the accompanying drawings, in which some, but not all embodiments of the invention are shown. Indeed, these inventions may be embodied in many different forms and should not be construed as limited to the embodiments set forth herein; rather, these embodiments are provided so that this disclosure will satisfy applicable legal requirements. Like numbers refer to like elements throughout.

Many modifications and other embodiments of the inventions set forth herein will come to mind to one skilled in the art to which these inventions pertain having the benefit of the teachings presented in the foregoing descriptions and the associated drawings. Therefore, it is to be understood that the inventions are not to be limited to the specific embodiments disclosed and that modifications and other embodiments are intended to be included within the scope of the appended claims. Although specific terms are employed herein, they are used in a generic and descriptive sense only and not for purposes of limitation.

The practice of the present invention will employ, unless otherwise indicated, conventional techniques of botany, microbiology, tissue culture, molecular biology, chemistry, biochemistry and recombinant DNA technology, which are within the skill of the art. Such techniques are explained fully in the literature. See, e.g., Langenheim and Thimann, BOTANY: PLANT BIOLOGY AND ITS RELATION TO HUMAN AFFAIRS, John Wiley (1982); CELL CULTURE AND SOMATIC CELL GENETICS OF PLANTS, vol. 1, Vasil, ed. (1984); Stanier, et al., THE MICROBIAL WORLD, $5^{th}$ ed., Prentice-Hall (1986); Dhringra and Sinclair, BASIC PLANT PATHOLOGY METHODS, CRC Press (1985); Maniatis, et al., MOLECULAR CLONING: A LABORATORY MANUAL (1982); DNA CLONING, vols. I and II, Glover, ed. (1985); OLIGONUCLEOTIDE SYNTHESIS, Gait, ed. (1984); NUCLEIC ACID HYBRIDIZATION, Hames and Higgins, eds. (1984); and the series METHODS IN ENZYMOLOGY, Colowick and Kaplan, eds, Academic Press, Inc., San Diego, Calif.

Units, prefixes, and symbols may be denoted in their SI accepted form. Unless otherwise indicated, nucleic acids are written left to right in 5' to 3' orientation; amino acid sequences are written left to right in amino to carboxy orientation, respectively. Numeric ranges are inclusive of the numbers defining the range. Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes. The terms defined below are more fully defined by reference to the specification as a whole.

In describing the present invention, the following terms will be employed, and are intended to be defined as indicated below.

By "microbe" is meant any microorganism (including both eukaryotic and prokaryotic microorganisms), such as fungi, yeast, bacteria, actinomycetes, algae and protozoa, as well as other unicellular structures.

By "amplified" is meant the construction of multiple copies of a nucleic acid sequence or multiple copies complementary to the nucleic acid sequence using at least one of the nucleic acid sequences as a template. Amplification systems include the polymerase chain reaction (PCR) system, ligase chain reaction (LCR) system, nucleic acid sequence based amplification (NASBA, Cangene, Mississauga, Ontario), Q-Beta Replicase systems, transcription-based amplification system (TAS), and strand displacement amplification (SDA). See, e.g., DIAGNOSTIC MOLECULAR MICROBIOLOGY: PRINCIPLES AND APPLICATIONS, Persing, et al., eds., American Society for Microbiology, Washington, D.C. (1993). The product of amplification is termed an amplicon.

The term "conservatively modified variants" applies to both amino acid and nucleic acid sequences. With respect to particular nucleic acid sequences, conservatively modified variants refer to those nucleic acids that encode identical or conservatively modified variants of the amino acid sequences. Because of the degeneracy of the genetic code, a large number of functionally identical nucleic acids encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations" and represent one species of conservatively modified variation. Every nucleic acid sequence herein that encodes a polypeptide also describes every possible silent variation of the nucleic acid. One of ordinary skill will recognize that each codon in a nucleic acid (except AUG, which is ordinarily the only codon for methionine; one exception is *Micrococcus rubens*, for which GTG is the methionine codon (Ishizuka, et al., (1993) *J. Gen. Micro-* biol. 139:425-32) can be modified to yield a functionally identical molecule. Accordingly, each silent variation of a nucleic acid, which encodes a polypeptide of the present invention, is implicit in each described polypeptide sequence and incorporated herein by reference.

As to amino acid sequences, one of skill will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" when the alteration results in the substitution of an amino acid with a chemically similar amino acid. Thus, any number of amino acid residues selected from the group of integers consisting of from 1 to 15 can be so altered. Thus, for example, 1, 2, 3, 4, 5, 7 or 10 alterations can be made. Conservatively modified variants typically provide similar biological activity as the unmodified polypeptide sequence from which they are derived. For example, substrate specificity, enzyme activity, or ligand/receptor binding is generally at least 30%, 40%, 50%, 60%, 70%, 80% or 90%, preferably 60-90% of the native protein for it's native substrate. Conservative substitution tables providing functionally similar amino acids are well known in the art.

The following six groups each contain amino acids that are conservative substitutions for one another:

1) Alanine (A), Serine (S), Threonine (T);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V); and
6) Phenylalanine (F), Tyrosine (Y), Tryptophan (W).

See also, Creighton, PROTEINS, W.H. Freeman and Co. (1984).

As used herein, "consisting essentially of" means the inclusion of additional sequences to an object polynucleotide where the additional sequences do not selectively hybridize, under stringent hybridization conditions, to the same cDNA as the polynucleotide and where the hybridization conditions include a wash step in 0.1×SSC and 0.1% sodium dodecyl sulfate at 65° C.

By "encoding" or "encoded," with respect to a specified nucleic acid, is meant comprising the information for translation into the specified protein. A nucleic acid encoding a protein may comprise non-translated sequences (e.g., introns) within translated regions of the nucleic acid, or may lack such intervening non-translated sequences (e.g., as in cDNA). The information by which a protein is encoded is specified by the use of codons. Typically, the amino acid sequence is encoded by the nucleic acid using the "universal" genetic code. However, variants of the universal code, such as is present in some plant, animal, and fungal mitochondria, the bacterium *Mycoplasma capricolumn* (Yamao, et al., (1985) *Proc. Natl. Acad. Sci. USA* 82:2306-2309), or the ciliate Macronucleus, may be used when the nucleic acid is expressed using these organisms.

When the nucleic acid is prepared or altered synthetically, advantage can be taken of known codon preferences of the intended host where the nucleic acid is to be expressed. For example, although nucleic acid sequences of the present invention may be expressed in both monocotyledonous and dicotyledonous plant species, sequences can be modified to account for the specific codon preferences and GC content preferences of monocotyledonous plants or dicotyledonous plants as these preferences have been shown to differ (Murray, et al., (1989) *Nucleic Acids Res.* 17:477-98 and herein incorporated by reference). Thus, the maize preferred codon for a particular amino acid might be derived from known gene sequences from maize. Maize codon usage for 28 genes from maize plants is listed in Table 4 of Murray, et al., supra.

As used herein, "heterologous" in reference to a nucleic acid is a nucleic acid that originates from a foreign species, or, if from the same species, is substantially modified from its native form in composition and/or genomic locus by deliberate human intervention. For example, a promoter operably linked to a heterologous structural gene is from a species different from that from which the structural gene was derived or, if from the same species, one or both are substantially modified from their original form. A heterologous protein may originate from a foreign species or, if from the same species, is substantially modified from its original form by deliberate human intervention.

By "host cell" is meant a cell, which contains a vector and supports the replication and/or expression of the expression vector. Host cells may be prokaryotic cells such as *E. coli*, or eukaryotic cells such as yeast, insect, plant, amphibian, or mammalian cells. Preferably, host cells are monocotyledonous or dicotyledonous plant cells, including but not limited to maize, sorghum, sunflower, soybean, wheat, alfalfa, rice, cotton, canola, barley, millet, and tomato. A particularly preferred monocotyledonous host cell is a maize host cell.

The term "hybridization complex" includes reference to a duplex nucleic acid structure formed by two single-stranded nucleic acid sequences selectively hybridized with each other.

The term "introduced" in the context of inserting a nucleic acid into a cell, means "transfection" or "transformation" or "transduction" and includes reference to the incorporation of a nucleic acid into a eukaryotic or prokaryotic cell where the nucleic acid may be incorporated into the genome of the cell (e.g., chromosome, plasmid, plastid or mitochondrial DNA), converted into an autonomous replicon, or transiently expressed (e.g., transfected mRNA).

The terms "isolated" refers to material, such as a nucleic acid or a protein, which is substantially or essentially free from components which normally accompany or interact with it as found in its naturally occurring environment. The isolated material optionally comprises material not found with the material in its natural environment. Nucleic acids, which are "isolated", as defined herein, are also referred to as "heterologous" nucleic acids. Unless otherwise stated, the term "SCW nucleic acid" means a nucleic acid comprising a polynucleotide ("SCW polynucleotide") encoding a SCW polypeptide.

As used herein, "nucleic acid" includes reference to a deoxyribonucleotide or ribonucleotide polymer in either single- or double-stranded form, and unless otherwise limited, encompasses known analogues having the essential nature of natural nucleotides in that they hybridize to single-stranded nucleic acids in a manner similar to naturally occurring nucleotides (e.g., peptide nucleic acids).

By "nucleic acid library" is meant a collection of isolated DNA or RNA molecules, which comprise and substantially represent the entire transcribed fraction of a genome of a specified organism. Construction of exemplary nucleic acid libraries, such as genomic and cDNA libraries, is taught in standard molecular biology references such as Berger and Kimmel, GUIDE TO MOLECULAR CLONING TECHNIQUES, from the series METHODS IN ENZYMOLOGY, vol. 152, Academic Press, Inc., San Diego, Calif. (1987); Sambrook, et al., MOLECULAR CLONING: A LABORATORY MANUAL, 2$^{nd}$ ed., vols. 1-3 (1989); and CURRENT PROTOCOLS 1N MOLECULAR BIOLOGY, Ausubel, et al., eds, Current Protocols, a joint venture between Greene Publishing Associates, Inc. and John Wiley & Sons, Inc. (1994 Supplement).

As used herein "operably linked" includes reference to a functional linkage between a first sequence, such as a promoter and a second sequence, wherein the promoter sequence initiates and mediates transcription of the DNA sequence corresponding to the second sequence. Generally, operably linked means that the nucleic acid sequences being linked are contiguous and, where necessary to join two protein coding regions, contiguous and in the same reading frame.

As used herein, the term "plant" includes reference to whole plants, plant organs (e.g., leaves, stems, roots, etc.), seeds and plant cells and progeny of same. Plant cell, as used herein includes, without limitation, seeds suspension cultures, embryos, meristematic regions, callus tissue, leaves, roots, shoots, gametophytes, sporophytes, pollen, and microspores. The class of plants, which can be used in the methods of the invention, is generally as broad as the class of higher plants amenable to transformation techniques, including both monocotyledonous and dicotyledonous plants including species from the genera: *Cucurbita, Rosa, Vitis, Juglans, Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersicon, Nicotiana, Solanum, Petunia, Digitalis, Majorana, Ciahorium, Helianthus, Lactuca, Bromus, Asparagus, Antirrhinum, Heterocallis, Nemesis, Pelargonium, Panieum, Pennisetum, Ranunculus, Senecio, Salpiglossis, Cucumis, Browaalia, Glycine, Pisum, Phaseolus, Lolium, Oryza, Avena, Hordeum, Secale, Allium*, and *Triticum*. A particularly preferred plant is *Zea mays*.

As used herein, "yield" includes reference to bushels per acre of a grain crop at harvest, as adjusted for grain moisture (15% typically). Grain moisture is measured in the grain at harvest. The adjusted test weight of grain is determined to be the weight in pounds per bushel, adjusted for grain moisture level at harvest.

As used herein, "polynucleotide" includes reference to a deoxyribopolynucleotide, ribopolynucleotide, or analogs thereof that have the essential nature of a natural ribonucleotide in that they hybridize, under stringent hybridization conditions, to substantially the same nucleotide sequence as naturally occurring nucleotides and/or allow translation into the same amino acid(s) as the naturally occurring nucleotide(s). A polynucleotide can be full-length or a subsequence of a native or heterologous structural or regulatory gene. Unless otherwise indicated, the term includes reference to the specified sequence as well as the complementary sequence thereof. Thus, DNAs or RNAs with backbones modified for stability or for other reasons are "polynucleotides" as that term is intended herein. Moreover, DNAs or RNAs comprising unusual bases, such as inosine, or modified bases, such as tritylated bases, to name just two examples, are polynucleotides as the term is used herein. It will be appreciated that a great variety of modifications have been made to DNA and RNA that serve many useful purposes known to those of skill in the art. The term polynucleotide as it is employed herein embraces such chemically, enzymatically or metabolically modified forms of polynucleotides, as well as the chemical forms of DNA and RNA characteristic of viruses and cells, including inter alia, simple and complex cells.

The terms "polypeptide," "peptide," and "protein" are used interchangeably herein to refer to a polymer of amino acid residues. The terms apply to amino acid polymers in which one or more amino acid residue is an artificial chemical analogue of a corresponding naturally occurring amino acid, as well as to naturally occurring amino acid polymers.

As used herein "promoter" includes reference to a region of DNA upstream from the start of transcription and involved in recognition and binding of RNA polymerase and other proteins to initiate transcription. A "plant promoter" is a promoter capable of initiating transcription in plant cells. Exemplary plant promoters include, but are not limited to, those that are obtained from plants, plant viruses, and bacteria which comprise genes expressed in plant cells such *Agrobacterium* or *Rhizobium*. Examples are promoters that preferentially initiate transcription in certain tissues, such as leaves, roots, seeds, fibres, xylem vessels, tracheids, or sclerenchyma. Such promoters are referred to as "tissue preferred." A "cell type" specific promoter primarily drives expression in certain cell types in one or more organs, for example, vascular cells in roots or leaves. An "inducible" or "regulatable" promoter is a promoter, which is under environmental control. Examples of environmental conditions that may effect transcription by inducible promoters include anaerobic conditions or the presence of light. Another type of promoter is a developmentally regulated promoter, for example, a promoter that drives expression during pollen development. Tissue preferred, cell type specific, developmentally regulated, and inducible promoters constitute the class of "non-constitutive" promoters. A "constitutive" promoter is a promoter, which is active under most environmental conditions.

The term "SCW polypeptide" refers to one or more amino acid sequences. The term is also inclusive of fragments, variants, homologs, alleles or precursors (e.g., preproproteins or proproteins) thereof. A "SCW protein" comprises a SCW polypeptide. Unless otherwise stated, the term "SCW nucleic acid" means a nucleic acid comprising a polynucleotide ("SCW polynucleotide") encoding a SCW polypeptide.

As used herein "recombinant" includes reference to a cell or vector, that has been modified by the introduction of a heterologous nucleic acid or that the cell is derived from a cell so modified. Thus, for example, recombinant cells express genes that are not found in identical form within the native (non-recombinant) form of the cell or express native genes that are otherwise abnormally expressed, under expressed or not expressed at all as a result of deliberate human intervention. The term "recombinant" as used herein does not encompass the alteration of the cell or vector by naturally occurring events (e.g., spontaneous mutation, natural transformation/transduction/transposition) such as those occurring without deliberate human intervention.

As used herein, a "recombinant expression cassette" is a nucleic acid construct, generated recombinantly or synthetically, with a series of specified nucleic acid elements, which permit transcription of a particular nucleic acid in a target cell. The recombinant expression cassette can be incorporated into a plasmid, chromosome, mitochondrial DNA, plastid DNA, virus, or nucleic acid fragment. Typically, the recombinant expression cassette portion of an expression vector includes, among other sequences, a nucleic acid to be transcribed, and a promoter.

The term "residue" or "amino acid residue" or "amino acid" are used interchangeably herein to refer to an amino acid that is incorporated into a protein, polypeptide, or peptide (collectively "protein"). The amino acid may be a naturally occurring amino acid and, unless otherwise limited, may encompass known analogs of natural amino acids that can function in a similar manner as naturally occurring amino acids.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 40% sequence identity, preferably 60-90% sequence identity, and most preferably 100% sequence identity (i.e., complementary) with each other.

The terms "stringent conditions" or "stringent hybridization conditions" include reference to conditions under which a probe will hybridize to its target sequence, to a detectably greater degree than other sequences (e.g., at least 2-fold over background). Stringent conditions are sequence-dependent and will be different in different circumstances. By controlling the stringency of the hybridization and/or washing conditions, target sequences can be identified which can be up to 100% complementary to the probe (homologous probing). Alternatively, stringency conditions can be adjusted to allow some mismatching in sequences so that lower degrees of similarity are detected (heterologous probing). Optimally, the probe is approximately 500 nucleotides in length, but can vary greatly in length from less than 500 nucleotides to equal to the entire length of the target sequence.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide or Denhardt's. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Specificity is typically the function of post-hybridization washes, the critical factors being the ionic strength and temperature of the final wash solution. For DNA-DNA hybrids, the $T_m$ can be approximated from the equation of Meinkoth and Wahl, (1984) *Anal. Biochem.* 138:267-84: $T_m$=81.5° C.+16.6 (log M)+0.41 (% GC)–0.61 (% form)–500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization and/or wash conditions can be adjusted to hybridize to sequences of the desired identity. For example, if sequences with >90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3 or 4° C. lower than the thermal melting point ($T_m$); moderately stringent conditions can utilize a hybridization and/or wash at 6, 7, 8, 9 or 10° C. lower than the thermal melting point ($T_m$); low stringency conditions can utilize a hybridization and/or wash at 11, 12, 13, 14, 15 or 20° C. lower than the thermal melting point ($T_m$).

Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution) it is preferred to increase the SSC concentration so that a higher temperature can be used. An extensive guide to the hybridization of nucleic acids is found in Tijssen, LABORATORY TECHNIQUES IN BIOCHEMISTRY AND MOLECULAR BIOLOGY—HYBRIDIZATION WITH NUCLEIC ACID PROBES, part I, chapter 2, "Overview of principles of hybridization and the strategy of nucleic acid probe assays," Elsevier, New York. (1993); and CURRENT PROTOCOLS IN MOLECULAR BIOLOGY, chapter 2, Ausubel, et al., eds, Greene Publishing and Wiley-Interscience, New York (1995). Unless otherwise stated, in the present application high stringency is defined as hybridization in 4×SSC, 5×Denhardt's (5 g Ficoll, 5 g polyvinylpyrrolidone, 5 g bovine serum albumin in 500 ml of water), 0.1 mg/ml boiled salmon sperm DNA, and 25 mM Na phosphate at 65° C., and a wash in 0.1×SSC, 0.1% SDS at 65° C.

As used herein, "transgenic plant" includes reference to a plant, which comprises within its genome a heterologous polynucleotide. Generally, the heterologous polynucleotide is stably integrated within the genome such that the polynucleotide is passed on to successive generations. The heterologous polynucleotide may be integrated into the genome alone or as part of a recombinant expression cassette. "Transgenic" is used herein to include any cell, cell line, callus, tissue, plant part or plant, the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition, or spontaneous mutation.

As used herein, "vector" includes reference to a nucleic acid used in transfection of a host cell and into which can be inserted a polynucleotide. Vectors are often replicons. Expression vectors permit transcription of a nucleic acid inserted therein.

The following terms are used to describe the sequence relationships between two or more nucleic acids or polynucleotides or polypeptides: (a) "reference sequence," (b) "comparison window," (c) "sequence identity," (d) "percentage of sequence identity," and (e) "substantial identity."

As used herein, "reference sequence" is a defined sequence used as a basis for sequence comparison. A reference sequence may be a subset or the entirety of a specified sequence; for example, as a segment of a full-length cDNA or gene sequence, or the complete cDNA or gene sequence.

As used herein, "comparison window" means includes reference to a contiguous and specified segment of a polynucleotide sequence, wherein the polynucleotide sequence may be compared to a reference sequence and wherein the portion of the polynucleotide sequence in the comparison window may comprise additions or deletions (i.e., gaps) compared to the reference sequence (which does not comprise additions or deletions) for optimal alignment of the two sequences. Generally, the comparison window is at least 20 contiguous nucleotides in length, and optionally can be 30, 40, 50, 100 or longer. Those of skill in the art understand that to avoid a high similarity to a reference sequence due to inclusion of gaps in the polynucleotide sequence a gap penalty is typically introduced and is subtracted from the number of matches.

Methods of alignment of nucleotide and amino acid sequences for comparison are well known in the art. The local homology algorithm (BESTFIT) of Smith and Waterman, (1981) *Adv. Appl. Math* 2:482, may conduct optimal alignment of sequences for comparison; by the homology alignment algorithm (GAP) of Needleman and Wunsch, (1970) *J. Mol. Biol.* 48:443-53; by the search for similarity method (Tfasta and Fasta) of Pearson and Lipman, (1988) *Proc. Natl. Acad. Sci. USA* 85:2444; by computerized implementations of these algorithms, including, but not limited to: CLUSTAL in the PC/Gene program by Intelligenetics, Mountain View, Calif., GAP, BESTFIT, BLAST, FASTA, and TFASTA in the Wisconsin Genetics Software Package, Version 8 (available from Genetics Computer Group (GCG® programs (Accelrys, Inc., San Diego, Calif.)). The CLUSTAL program is well described by Higgins and Sharp, (1988) *Gene* 73:237-44; Higgins and Sharp, (1989) *CABIOS* 5:151-3; Corpet, et al., (1988) *Nucleic Acids Res.* 16:10881-90; Huang, et al., (1992) *Computer Applications in the Biosciences* 8:155-65, and Pearson, et al., (1994) *Meth. Mol. Biol.* 24:307-31. The preferred program to use for optimal global alignment of multiple sequences is PileUp (Feng and Doolittle, (1987) *J. Mol. Evol.*, 25:351-60 which is similar to the method described by Higgins and Sharp, (1989) *CABIOS* 5:151-53 and hereby incorporated by reference). The BLAST family of programs which can be used for database similarity searches includes: BLASTN for nucleotide query sequences against nucleotide database sequences; BLASTX for nucleotide query sequences against protein database sequences; BLASTP for protein query sequences against protein database sequences; TBLASTN for protein query sequences against nucleotide database sequences; and TBLASTX for nucleotide query sequences against nucleotide database sequences. See, CURRENT PROTOCOLS IN MOLECULAR BIOLOGY, Chapter 19, Ausubel, et al., eds., Greene Publishing and Wiley-Interscience, New York (1995).

GAP uses the algorithm of Needleman and Wunsch, supra, to find the alignment of two complete sequences that maximizes the number of matches and minimizes the number of gaps. GAP considers all possible alignments and gap positions and creates the alignment with the largest number of matched bases and the fewest gaps. It allows for the provision of a gap creation penalty and a gap extension penalty in units of matched bases. GAP must make a profit of gap creation penalty number of matches for each gap it inserts. If a gap extension penalty greater than zero is chosen, GAP must, in addition, make a profit for each gap inserted of the length of the gap times the gap extension penalty. Default gap creation penalty values and gap extension penalty values in Version 10 of the Wisconsin Genetics Software Package are 8 and 2, respectively. The gap creation and gap extension penalties can be expressed as an integer selected from the group of integers consisting of from 0 to 100. Thus, for example, the gap creation and gap extension penalties can be 0, 1, 2, 3, 4, 5, 6, 7, 8, 9, 10, 15, 20, 30, 40, 50 or greater.

GAP presents one member of the family of best alignments. There may be many members of this family, but no other member has a better quality. GAP displays four figures of merit for alignments: Quality, Ratio, Identity, and Similarity. The Quality is the metric maximized in order to align the sequences. Ratio is the quality divided by the number of bases in the shorter segment. Percent Identity is the percent of the symbols that actually match. Percent Similarity is the percent of the symbols that are similar. Symbols that are across from gaps are ignored. A similarity is scored when the scoring matrix value for a pair of symbols is greater than or equal to 0.50, the similarity threshold. The scoring matrix used in Version 10 of the Wisconsin Genetics Software Package is BLOSUM62 (see, Henikoff and Henikoff, (1989) *Proc. Natl. Acad. Sci. USA* 89:10915).

Unless otherwise stated, sequence identity/similarity values provided herein refer to the value obtained using the BLAST 2.0 suite of programs using default parameters (Altschul, et al., (1997) *Nucleic Acids Res.* 25:3389-402).

As those of ordinary skill in the art will understand, BLAST searches assume that proteins can be modeled as random sequences. However, many real proteins comprise regions of nonrandom sequences, which may be homopolymeric tracts, short-period repeats, or regions enriched in one or more amino acids. Such low-complexity regions may be aligned between unrelated proteins even though other regions of the protein are entirely dissimilar. A number of low-complexity filter programs can be employed to reduce such low-complexity alignments. For example, the SEG (Wooten and Federhen, (1993) *Comput. Chem.* 17:149-63) and XNU (Claverie and States, (1993) *Comput. Chem.* 17:191-201) low-complexity filters can be employed alone or in combination.

As used herein, "sequence identity" or "identity" in the context of two nucleic acid or polypeptide sequences includes reference to the residues in the two sequences, which are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. Where sequences differ in conservative substitutions, the percent sequence identity may be adjusted upwards to correct for the conservative nature of the substitution. Sequences, which differ by such conservative substitutions, are said to have "sequence similarity" or "similarity." Means for making this adjustment are well known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Meyers and Miller, (1988) *Computer Applic. Biol. Sci.* 4:11-17, e.g., as implemented in the program PC/GENE (Intelligenetics, Mountain View, Calif., USA).

As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

The term "substantial identity" of polynucleotide sequences means that a polynucleotide comprises a sequence that has between 50-100% sequence identity, preferably at least 50% sequence identity, preferably at least 60% sequence identity, preferably at least 70%, more preferably at least 80%, more preferably at least 90%, and most preferably at least 95%, compared to a reference sequence using one of the alignment programs described using standard parameters. One of skill will recognize that these values can be appropriately adjusted to determine corresponding identity of proteins encoded by two nucleotide sequences by taking into account codon degeneracy, amino acid similarity, reading frame positioning and the like. Substantial identity of amino acid sequences for these purposes normally means sequence identity of between 55-100%, preferably at least 55%, preferably at least 60%, more preferably at least 70%, 80%, 90% and most preferably at least 95%.

Another indication that nucleotide sequences are substantially identical is if two molecules hybridize to each other under stringent conditions. The degeneracy of the genetic code allows for many amino acids substitutions that lead to variety in the nucleotide sequence that code for the same amino acid, hence it is possible that the DNA sequence could code for the same polypeptide but not hybridize to each other under stringent conditions. This may occur, e.g., when a copy of a nucleic acid is created using the maximum codon degeneracy permitted by the genetic code. One indication that two nucleic acid sequences are substantially identical is that the polypeptide, which the first nucleic acid encodes, is immunologically cross reactive with the polypeptide encoded by the second nucleic acid.

The terms "substantial identity" in the context of a peptide indicates that a peptide comprises a sequence with between 55-100% sequence identity to a reference sequence preferably at least 55% sequence identity, preferably 60% preferably 70%, more preferably 80%, most preferably at least 90% or 95% sequence identity to the reference sequence over a specified comparison window. Preferably, optimal alignment is conducted using the homology alignment algorithm of Needleman and Wunsch, supra. An indication that two peptide sequences are substantially identical is that one peptide is immunologically reactive with antibodies raised against the second peptide. Thus, a peptide is substantially identical to a second peptide, for example, where the two peptides differ only by a conservative substitution. In addition, a peptide can be substantially identical to a second peptide when they differ by a non-conservative change if the epitope that the antibody recognizes is substantially identical. Peptides, which are "substantially similar" share sequences as, noted above except that residue positions, which are not identical, may differ by conservative amino acid changes.

The invention discloses SCW polynucleotides and polypeptides. The novel nucleotides and proteins of the invention have an expression pattern which indicates that they alter cell wall formation and thus play an important role in plant development. The polynucleotides are expressed in various plant tissues. The polynucleotides and polypeptides thus provide an opportunity to manipulate plant development to alter seed and vegetative tissue development, timing or composition. This may be used to create a sterile plant, a seedless plant or a plant with altered endosperm composition.

Nucleic Acids

The present invention provides, inter alia, isolated nucleic acids of RNA, DNA, and analogs and/or chimeras thereof, comprising a SCW polynucleotide.

The present invention also includes polynucleotides optimized for expression in different organisms. For example, for expression of the polynucleotide in a maize plant, the sequence can be altered to account for specific codon preferences and to alter GC content as according to Murray, et al, supra. Maize codon usage for 28 genes from maize plants is listed in Table 4 of Murray, et al., supra.

The SCW nucleic acids of the present invention comprise isolated SCW polynucleotides which are inclusive of:

(a) a polynucleotide encoding a SCW polypeptide and conservatively modified and polymorphic variants thereof;

(b) a polynucleotide having at least 70% sequence identity with polynucleotides of (a) or (b);

(c) complementary sequences of polynucleotides of (a) or (b).

The following table, Table 1, lists the specific identities of the *Zea mays* sequences disclosed herein. An additional table, Table 2, lists the specific identities of the SCW sequence orthologs in *Oryza sativa* (Os), *Arabidopsis thaliana* (At), *Populus trichocarpa* (Pt), *Medicago truncatula* (Mt), and *Sorghum bicolor* (Sb) disclosed herein.

TABLE 1

| SCW group | Maize Sequence Identity | SEQ ID NO: |
| --- | --- | --- |
| SCW01 | Polynucleotide- ORF | SEQ ID NO: 1 |
| | Polypeptide | SEQ ID NO: 2 |
| | Polynucleotide transcript | SEQ ID NO: 77 |
| | Promoter | SEQ ID NO: 425 |
| SCW04 | Polynucleotide- ORF | SEQ ID NO: 3 |
| | Polypeptide | SEQ ID NO: 4 |
| | Polynucleotide transcript | SEQ ID NO: 78 |
| SCW05 | Polynucleotide- ORF | SEQ ID NO: 5 |
| | Polypeptide | SEQ ID NO: 6 |
| | Polynucleotide transcript | SEQ ID NO: 79 |
| | Promoter | SEQ ID NO: 426 |
| SCW06 | Polynucleotide- ORF | SEQ ID NO: 7 |
| | Polypeptide | SEQ ID NO: 8 |
| | Polynucleotide transcript | SEQ ID NO: 80 |
| | Promoter | SEQ ID NO: 427 |
| SCW08 | Polynucleotide- ORF | SEQ ID NO: 9 |
| | Polypeptide | SEQ ID NO: 10 |
| | Polynucleotide transcript | SEQ ID NO: 81 |
| SCW09 | Polynucleotide- ORF | SEQ ID NO: 11 |
| | Polypeptide | SEQ ID NO: 12 |
| | Polynucleotide transcript | SEQ ID NO: 82 |
| SCW10 | Polynucleotide- ORF | SEQ ID NO: 13 |
| | Polypeptide | SEQ ID NO: 14 |
| | Polynucleotide transcript | SEQ ID NO: 83 |
| | Promoter | SEQ ID NO: 428 |
| SCW11a | Polynucleotide- ORF | SEQ ID NO: 15 |
| | Polypeptide | SEQ ID NO: 16 |
| | Polynucleotide transcript | SEQ ID NO: 84 |
| | Promoter | SEQ ID NO: 429 |
| SCW11b | Polynucleotide- ORF | SEQ ID NO: 17 |
| | Polypeptide | SEQ ID NO: 18 |
| | Polynucleotide transcript | SEQ ID NO: 85 |
| | Promoter | SEQ ID NO: 430 |
| SCW13 | Polynucleotide- ORF | SEQ ID NO: 19 |
| | Polypeptide | SEQ ID NO: 20 |
| | Polynucleotide transcript | SEQ ID NO: 86 |
| | Promoter | SEQ ID NO: 431 |
| SCW16 | Polynucleotide- ORF | SEQ ID NO: 21 |
| | Polypeptide | SEQ ID NO: 22 |
| | Polynucleotide transcript | SEQ ID NO: 87 |
| | Promoter | SEQ ID NO: 432 |
| SCW17 | Polynucleotide- ORF | SEQ ID NO: 23 |
| | Polypeptide | SEQ ID NO: 24 |
| | Polynucleotide transcript | SEQ ID NO: 88 |
| | Promoter | SEQ ID NO: 433 |
| SCW21 | Polynucleotide- ORF | SEQ ID NO: 25 |
| | Polypeptide | SEQ ID NO: 26 |
| | Polynucleotide transcript | SEQ ID NO: 89 |
| | Promoter | SEQ ID NO: 434 |

TABLE 1-continued

| SCW group | Maize Sequence Identity | SEQ ID NO: |
|---|---|---|
| SCW22 | Polynucleotide- ORF | SEQ ID NO: 27 |
|  | Polypeptide | SEQ ID NO: 28 |
|  | Polynucleotide transcript | SEQ ID NO: 90 |
|  | Promoter | SEQ ID NO: 435 |
| SCW23 | Polynucleotide- ORF | SEQ ID NO: 29 |
|  | Polypeptide | SEQ ID NO: 30 |
|  | Polynucleotide transcript | SEQ ID NO: 91 |
|  | Promoter | SEQ ID NO: 436 |
| SCW26 | Polynucleotide- ORF | SEQ ID NO: 31 |
|  | Polypeptide | SEQ ID NO: 32 |
|  | Polynucleotide transcript | SEQ ID NO: 92 |
| SCW28 | Polynucleotide- ORF | SEQ ID NO: 33 |
|  | Polypeptide | SEQ ID NO: 34 |
|  | Polynucleotide transcript | SEQ ID NO: 93 |
|  | Promoter | SEQ ID NO: 437 |
| SCW32 | Polynucleotide- ORF | SEQ ID NO: 35 |
|  | Polypeptide | SEQ ID NO: 36 |
|  | Polynucleotide transcript | SEQ ID NO: 94 |
| SCW34 | Polynucleotide- ORF | SEQ ID NO: 37 |
|  | Polypeptide | SEQ ID NO: 38 |
|  | Polynucleotide transcript | SEQ ID NO: 95 |
|  | Promoter | SEQ ID NO: 438 |
| SCW38 | Polynucleotide- ORF | SEQ ID NO: 39 |
|  | Polypeptide | SEQ ID NO: 40 |
|  | Polynucleotide transcript | SEQ ID NO: 96 |
|  | Promoter | SEQ ID NO: 439 |
| SCW39 | Polynucleotide- ORF | SEQ ID NO: 41 |
|  | Polypeptide | SEQ ID NO: 42 |
|  | Polynucleotide transcript | SEQ ID NO: 97 |
|  | Promoter | SEQ ID NO: 440 |
| SCW40 | Polynucleotide- ORF | SEQ ID NO: 43 |
|  | Polypeptide | SEQ ID NO: 44 |
|  | Polynucleotide transcript | SEQ ID NO: 98 |
|  | Promoter | SEQ ID NO: 441 |
| SCW41 | Polynucleotide- ORF | SEQ ID NO: 45 |
|  | Polypeptide | SEQ ID NO: 46 |
|  | Polynucleotide transcript | SEQ ID NO: 99 |
|  | Promoter | SEQ ID NO: 442 |
| SCW43 | Polynucleotide- ORF | SEQ ID NO: 47 |
|  | Polypeptide | SEQ ID NO: 48 |
|  | Polynucleotide transcript | SEQ ID NO: 100 |
|  | Promoter | SEQ ID NO: 443 |
| SCW44 | Polynucleotide- ORF | SEQ ID NO: 49 |
|  | Polypeptide | SEQ ID NO: 50 |
|  | Polynucleotide transcript | SEQ ID NO: 101 |
|  | Promoter | SEQ ID NO: 444 |
| SCW45 | Polynucleotide- ORF | SEQ ID NO: 51 |
|  | Polypeptide | SEQ ID NO: 52 |
|  | Polynucleotide transcript | SEQ ID NO: 102 |
|  | Promoter | SEQ ID NO: 445 |
| SCW46 | Polynucleotide- ORF | SEQ ID NO: 53 |
|  | Polypeptide | SEQ ID NO: 54 |
|  | Polynucleotide transcript | SEQ ID NO: 103 |
|  | Promoter | SEQ ID NO: 446 |
| SCW47 | Polynucleotide- ORF | SEQ ID NO: 55 |
|  | Polypeptide | SEQ ID NO: 56 |
|  | Polynucleotide transcript | SEQ ID NO: 104 |
|  | Promoter | SEQ ID NO: 447 |
| SCW48 | Polynucleotide- ORF | SEQ ID NO: 57 |
|  | Polypeptide | SEQ ID NO: 58 |
|  | Polynucleotide transcript | SEQ ID NO: 105 |
|  | Promoter | SEQ ID NO: 448 |
| SCW49 | Polynucleotide- ORF | SEQ ID NO: 59 |
|  | Polypeptide | SEQ ID NO: 60 |
|  | Polynucleotide transcript | SEQ ID NO: 106 |
|  | Promoter | SEQ ID NO: 449 |
| SCW50 | Polynucleotide- ORF | SEQ ID NO: 61 |
|  | Polypeptide | SEQ ID NO: 62 |
|  | Polynucleotide transcript | SEQ ID NO: 107 |
|  | Promoter | SEQ ID NO: 450 |
| SCW51 | Polynucleotide- ORF | SEQ ID NO: 63 |
|  | Polypeptide | SEQ ID NO: 64 |
|  | Polynucleotide transcript | SEQ ID NO: 108 |
| SCW53 | Polynucleotide- ORF | SEQ ID NO: 65 |
|  | Polypeptide | SEQ ID NO: 66 |
|  | Polynucleotide transcript | SEQ ID NO: 109 |
|  | Promoter | SEQ ID NO: 451 |
| SCW54 | Polynucleotide- ORF | SEQ ID NO: 67 |
|  | Polypeptide | SEQ ID NO: 68 |
|  | Polynucleotide transcript | SEQ ID NO: 110 |
|  | Promoter | SEQ ID NO: 452 |
| SCW55 | Polynucleotide- ORF | SEQ ID NO: 69 |
|  | Polypeptide | SEQ ID NO: 70 |
|  | Polynucleotide transcript | SEQ ID NO: 111 |
|  | Promoter | SEQ ID NO: 453 |
| SCW56 | Polynucleotide- ORF | SEQ ID NO: 71 |
|  | Polypeptide | SEQ ID NO: 72 |
|  | Polynucleotide transcript | SEQ ID NO: 112 |
|  | Promoter | SEQ ID NO: 454 |
| SCW57 | Polynucleotide- ORF | SEQ ID NO: 73 |
|  | Polypeptide | SEQ ID NO: 74 |
|  | Polynucleotide transcript | SEQ ID NO: 113 |
|  | Promoter | SEQ ID NO: 455 |
| SCW58 | Polynucleotide- ORF | SEQ ID NO: 75 |
|  | Polypeptide | SEQ ID NO: 76 |
|  | Polynucleotide transcript | SEQ ID NO: 114 |
|  | Promoter | SEQ ID NO: 456 |

TABLE 2

| SCW group for other species | Identity | SEQ ID NO: |
|---|---|---|
| SCW01 | At1 Polypeptide | SEQ ID NO: 115 |
|  | At1 Polynucleotide transcript | SEQ ID NO: 116 |
|  | At2 Polypeptide | SEQ ID NO: 117 |
|  | At2 Polynucleotide transcript | SEQ ID NO: 118 |
|  | Os Polypeptide | SEQ ID NO: 119 |
|  | Os Polynucleotide transcript | SEQ ID NO: 120 |
|  | Pt1 Polypeptide | SEQ ID NO: 121 |
|  | Pt1 Polynucleotide transcript | SEQ ID NO: 122 |
|  | Pt2 Polypeptide | SEQ ID NO: 123 |
|  | Pt2 Polynucleotide transcript | SEQ ID NO: 124 |
| SCW04 | At1 Polypeptide | SEQ ID NO: 125 |
|  | At1 Polynucleotide transcript | SEQ ID NO: 126 |
|  | At2 Polypeptide | SEQ ID NO: 127 |
|  | At2 Polynucleotide transcript | SEQ ID NO: 128 |
|  | Mt Polypeptide | SEQ ID NO: 129 |
|  | Mt Polynucleotide transcript | SEQ ID NO: 130 |
|  | Os Polypeptide | SEQ ID NO: 131 |
|  | Os Polynucleotide transcript | SEQ ID NO: 132 |
|  | Pt1 Polypeptide | SEQ ID NO: 133 |
|  | Pt1 Polynucleotide transcript | SEQ ID NO: 134 |
|  | Pt2 Polypeptide | SEQ ID NO: 135 |
|  | Pt2 Polynucleotide transcript | SEQ ID NO: 136 |
| SCW05 | Os Polypeptide | SEQ ID NO: 137 |
|  | Os Polynucleotide transcript | SEQ ID NO: 138 |
| SCW06 | At1 Polypeptide | SEQ ID NO: 139 |
|  | At1 Polynucleotide transcript | SEQ ID NO: 140 |
|  | At2 Polypeptide | SEQ ID NO: 141 |
|  | At2 Polynucleotide transcript | SEQ ID NO: 142 |
|  | Mt Polypeptide | SEQ ID NO: 143 |
|  | Mt Polynucleotide transcript | SEQ ID NO: 144 |
|  | Os Polypeptide | SEQ ID NO: 145 |
|  | Os Polynucleotide transcript | SEQ ID NO: 146 |
|  | Pt Polypeptide | SEQ ID NO: 147 |
|  | Pt Polynucleotide transcript | SEQ ID NO: 148 |
|  | Sb Polypeptide | SEQ ID NO: 149 |
|  | Sb Polynucleotide transcript | SEQ ID NO: 150 |
| SCW08 | At Polypeptide | SEQ ID NO: 151 |
|  | At Polynucleotide transcript | SEQ ID NO: 152 |
|  | Os Polypeptide | SEQ ID NO: 153 |
|  | Os Polynucleotide transcript | SEQ ID NO: 154 |
|  | Pt Polypeptide | SEQ ID NO: 155 |
|  | Pt Polynucleotide transcript | SEQ ID NO: 156 |
| SCW09 | At Polypeptide | SEQ ID NO: 157 |
|  | At Polynucleotide transcript | SEQ ID NO: 158 |
|  | Mt Polypeptide | SEQ ID NO: 159 |
|  | Mt Polynucleotide transcript | SEQ ID NO: 160 |
|  | Os Polypeptide | SEQ ID NO: 161 |
|  | Os Polynucleotide transcript | SEQ ID NO: 162 |

TABLE 2-continued

| SCW group for other species | Identity | SEQ ID NO: |
|---|---|---|
| | Pt1 Polypeptide | SEQ ID NO: 163 |
| | Pt1 Polynucleotide transcript | SEQ ID NO: 164 |
| | Pt2 Polypeptide | SEQ ID NO: 165 |
| | Pt2 Polynucleotide transcript | SEQ ID NO: 166 |
| SCW10 | At Polypeptide | SEQ ID NO: 167 |
| | At Polynucleotide transcript | SEQ ID NO: 168 |
| | Mt Polypeptide | SEQ ID NO: 169 |
| | Mt Polynucleotide transcript | SEQ ID NO: 170 |
| | Os Polypeptide | SEQ ID NO: 171 |
| | Os Polynucleotide transcript | SEQ ID NO: 172 |
| | Pt1 Polypeptide | SEQ ID NO: 173 |
| | Pt1 Polynucleotide transcript | SEQ ID NO: 174 |
| | Pt2 Polypeptide | SEQ ID NO: 175 |
| | Pt2 Polynucleotide transcript | SEQ ID NO: 176 |
| SCW11a | Af Polypeptide | SEQ ID NO: 177 |
| | At Polypeptide | SEQ ID NO: 178 |
| | Mt Polypeptide | SEQ ID NO: 179 |
| | Mt Polynucleotide transcript | SEQ ID NO: 180 |
| | Os Polypeptide | SEQ ID NO: 181 |
| | Os Polynucleotide transcript | SEQ ID NO: 182 |
| | Pt Polypeptide | SEQ ID NO: 183 |
| | Pt Polynucleotide transcript | SEQ ID NO: 184 |
| | Sb Polynucleotide transcript | SEQ ID NO: 411 |
| SCW11b | Mt Polypeptide | SEQ ID NO: 185 |
| | Mt Polynucleotide transcript | SEQ ID NO: 186 |
| | Os Polypeptide | SEQ ID NO: 187 |
| | Os Polynucleotide transcript | SEQ ID NO: 188 |
| | Pt Polypeptide | SEQ ID NO: 189 |
| | Pt Polynucleotide transcript | SEQ ID NO: 190 |
| SCW13 | At Polypeptide | SEQ ID NO: 191 |
| | At Polynucleotide transcript | SEQ ID NO: 192 |
| | Mt Polypeptide | SEQ ID NO: 193 |
| | Mt Polynucleotide transcript | SEQ ID NO: 194 |
| | Os Polypeptide | SEQ ID NO: 195 |
| | Os Polynucleotide transcript | SEQ ID NO: 196 |
| | Pt Polypeptide | SEQ ID NO: 197 |
| | Pt Polynucleotide transcript | SEQ ID NO: 198 |
| | Sb1 Polynucleotide transcript | SEQ ID NO: 412 |
| | Sb2 Polynucleotide transcript | SEQ ID NO: 413 |
| SCW16 | Os Polypeptide | SEQ ID NO: 199 |
| | Os Polynucleotide transcript | SEQ ID NO: 200 |
| | Sb Polynucleotide transcript | SEQ ID NO: 414 |
| SCW17 | Os Polypeptide | SEQ ID NO: 201 |
| | Os Polynucleotide transcript | SEQ ID NO: 202 |
| SCW21 | At Polypeptide | SEQ ID NO: 203 |
| | At Polynucleotide transcript | SEQ ID NO: 204 |
| | Os Polypeptide | SEQ ID NO: 205 |
| | Os Polynucleotide transcript | SEQ ID NO: 206 |
| SCW22 | At Polypeptide | SEQ ID NO: 207 |
| | At Polynucleotide transcript | SEQ ID NO: 208 |
| | Mt Polypeptide | SEQ ID NO: 209 |
| | Mt Polynucleotide transcript | SEQ ID NO: 210 |
| | Os Polypeptide | SEQ ID NO: 211 |
| | Os Polynucleotide transcript | SEQ ID NO: 212 |
| | Pt Polypeptide | SEQ ID NO: 213 |
| | Pt Polynucleotide transcript | SEQ ID NO: 214 |
| | Sb1 Polypeptide | SEQ ID NO: 215 |
| | Sb1 Polynucleotide transcript | SEQ ID NO: 216 |
| | Sb2 Polypeptide | SEQ ID NO: 217 |
| | Sb2 Polynucleotide transcript | SEQ ID NO: 218 |
| SCW23 | At Polypeptide | SEQ ID NO: 219 |
| | At Polynucleotide transcript | SEQ ID NO: 220 |
| | Os Polypeptide | SEQ ID NO: 221 |
| | Os Polynucleotide transcript | SEQ ID NO: 222 |
| | Pt Polypeptide | SEQ ID NO: 223 |
| | Pt Polynucleotide transcript | SEQ ID NO: 224 |
| | Sb Polynucleotide transcript | SEQ ID NO: 415 |
| SCW26 | At Polypeptide | SEQ ID NO: 225 |
| | At Polynucleotide transcript | SEQ ID NO: 226 |
| | Mt Polypeptide | SEQ ID NO: 227 |
| | Mt Polynucleotide transcript | SEQ ID NO: 228 |
| | Os Polypeptide | SEQ ID NO: 229 |
| | Os Polynucleotide transcript | SEQ ID NO: 230 |
| | Pt1 Polypeptide | SEQ ID NO: 231 |
| | Pt1 Polynucleotide transcript | SEQ ID NO: 232 |
| | Pt2 Polypeptide | SEQ ID NO: 233 |
| | Pt2 Polynucleotide transcript | SEQ ID NO: 234 |
| | Sb Polypeptide | SEQ ID NO: 235 |
| | Sb Polynucleotide transcript | SEQ ID NO: 236 |
| SCW28 | At Polypeptide | SEQ ID NO: 237 |
| | At Polynucleotide transcript | SEQ ID NO: 238 |
| | Mt Polypeptide | SEQ ID NO: 239 |
| | Mt Polynucleotide transcript | SEQ ID NO: 240 |
| | Os Polypeptide | SEQ ID NO: 241 |
| | Os Polynucleotide transcript | SEQ ID NO: 242 |
| | Pt Polypeptide | SEQ ID NO: 243 |
| | Pt Polynucleotide transcript | SEQ ID NO: 244 |
| | Sb Polypeptide | SEQ ID NO: 245 |
| | Sb Polynucleotide transcript | SEQ ID NO: 246 |
| SCW32 | At Polypeptide | SEQ ID NO: 247 |
| | At Polynucleotide transcript | SEQ ID NO: 248 |
| | Mt Polypeptide | SEQ ID NO: 249 |
| | Mt Polynucleotide transcript | SEQ ID NO: 250 |
| | Os Polypeptide | SEQ ID NO: 251 |
| | Os Polynucleotide transcript | SEQ ID NO: 252 |
| | Pt Polypeptide | SEQ ID NO: 253 |
| | Pt Polynucleotide transcript | SEQ ID NO: 254 |
| | Sb Polynucleotide transcript | SEQ ID NO: 416 |
| SCW34 | At Polypeptide | SEQ ID NO: 255 |
| | At Polynucleotide transcript | SEQ ID NO: 256 |
| | Os Polypeptide | SEQ ID NO: 257 |
| | Os Polynucleotide transcript | SEQ ID NO: 258 |
| | Pt Polypeptide | SEQ ID NO: 259 |
| | Pt Polynucleotide transcript | SEQ ID NO: 260 |
| | Sb Polypeptide | SEQ ID NO: 261 |
| | Sb Polynucleotide transcript | SEQ ID NO: 262 |
| SCW38 | At Polypeptide | SEQ ID NO: 263 |
| | At Polynucleotide transcript | SEQ ID NO: 264 |
| | Mt Polypeptide | SEQ ID NO: 265 |
| | Mt Polynucleotide transcript | SEQ ID NO: 266 |
| | Os Polypeptide | SEQ ID NO: 267 |
| | Os Polynucleotide transcript | SEQ ID NO: 268 |
| | Pt1 Polypeptide | SEQ ID NO: 269 |
| | Pt1 Polynucleotide transcript | SEQ ID NO: 270 |
| | Pt2 Polypeptide | SEQ ID NO: 271 |
| | Pt2 Polynucleotide transcript | SEQ ID NO: 272 |
| | Sb Polynucleotide transcript | SEQ ID NO: 417 |
| SCW39 | At Polypeptide | SEQ ID NO: 273 |
| | At Polynucleotide transcript | SEQ ID NO: 274 |
| | Mt Polypeptide | SEQ ID NO: 275 |
| | Mt Polynucleotide transcript | SEQ ID NO: 276 |
| | Os1 Polypeptide | SEQ ID NO: 277 |
| | Os1 Polynucleotide transcript | SEQ ID NO: 278 |
| | Os2 Polypeptide | SEQ ID NO: 279 |
| | Os2 Polynucleotide transcript | SEQ ID NO: 280 |
| | Pt Polypeptide | SEQ ID NO: 281 |
| | Pt Polynucleotide transcript | SEQ ID NO: 282 |
| | Sb Polypeptide | SEQ ID NO: 283 |
| | Sb Polynucleotide transcript | SEQ ID NO: 284 |
| SCW40 | At Polypeptide | SEQ ID NO: 285 |
| | At Polynucleotide transcript | SEQ ID NO: 286 |
| | Mt Polypeptide | SEQ ID NO: 287 |
| | Mt Polynucleotide transcript | SEQ ID NO: 288 |
| | Os Polypeptide | SEQ ID NO: 289 |
| | Os Polynucleotide transcript | SEQ ID NO: 290 |
| | Sb Polynucleotide transcript | SEQ ID NO: 418 |
| SCW41 | At Polypeptide | SEQ ID NO: 291 |
| | At Polynucleotide transcript | SEQ ID NO: 292 |
| | Mt Polypeptide | SEQ ID NO: 293 |
| | Mt Polynucleotide transcript | SEQ ID NO: 294 |
| | Os Polypeptide | SEQ ID NO: 295 |
| | Os Polynucleotide transcript | SEQ ID NO: 296 |
| | Pt Polypeptide | SEQ ID NO: 297 |
| | Pt Polynucleotide transcript | SEQ ID NO: 298 |
| | Sb Polypeptide | SEQ ID NO: 299 |
| | Sb Polynucleotide transcript | SEQ ID NO: 300 |
| SCW43 | At Polypeptide | SEQ ID NO: 301 |
| | At Polynucleotide transcript | SEQ ID NO: 302 |
| | Os Polypeptide | SEQ ID NO: 303 |
| | Os Polynucleotide transcript | SEQ ID NO: 304 |

TABLE 2-continued

| SCW group for other species | Identity | SEQ ID NO: |
|---|---|---|
| | Sb Polypeptide | SEQ ID NO: 305 |
| | Sb Polynucleotide transcript | SEQ ID NO: 306 |
| SCW44 | Mt1 Polypeptide | SEQ ID NO: 307 |
| | Mt1 Polynucleotide transcript | SEQ ID NO: 308 |
| | Mt2 Polypeptide | SEQ ID NO: 309 |
| | Mt2 Polynucleotide transcript | SEQ ID NO: 310 |
| | Os Polypeptide | SEQ ID NO: 311 |
| | Os Polynucleotide transcript | SEQ ID NO: 312 |
| | Sb Polynucleotide transcript | SEQ ID NO: 419 |
| SCW45 | At Polypeptide | SEQ ID NO: 313 |
| | At Polynucleotide transcript | SEQ ID NO: 314 |
| | Mt Polypeptide | SEQ ID NO: 315 |
| | Mt Polynucleotide transcript | SEQ ID NO: 316 |
| | Os1 Polypeptide | SEQ ID NO: 317 |
| | Os1 Polynucleotide transcript | SEQ ID NO: 318 |
| | Os2 Polypeptide | SEQ ID NO: 319 |
| | Os2 Polynucleotide transcript | SEQ ID NO: 320 |
| | Pt Polypeptide | SEQ ID NO: 321 |
| | Pt Polynucleotide transcript | SEQ ID NO: 322 |
| | Sb Polynucleotide transcript | SEQ ID NO: 420 |
| SCW46 | At Polypeptide | SEQ ID NO: 323 |
| | At Polynucleotide transcript | SEQ ID NO: 324 |
| | Os Polypeptide | SEQ ID NO: 325 |
| | Os Polynucleotide transcript | SEQ ID NO: 326 |
| | Pt1 Polypeptide | SEQ ID NO: 327 |
| | Pt1 Polynucleotide transcript | SEQ ID NO: 328 |
| | Pt2 Polypeptide | SEQ ID NO: 329 |
| | Pt2 Polynucleotide transcript | SEQ ID NO: 330 |
| | Sb Polypeptide | SEQ ID NO: 331 |
| | Sb Polynucleotide transcript | SEQ ID NO: 332 |
| SCW47 | At Polypeptide | SEQ ID NO: 333 |
| | At Polynucleotide transcript | SEQ ID NO: 334 |
| | Mt Polypeptide | SEQ ID NO: 335 |
| | Mt Polynucleotide transcript | SEQ ID NO: 336 |
| | Os Polypeptide | SEQ ID NO: 337 |
| | Os Polynucleotide transcript | SEQ ID NO: 338 |
| | Pt Polypeptide | SEQ ID NO: 339 |
| | Pt Polynucleotide transcript | SEQ ID NO: 340 |
| | Sb Polynucleotide transcript | SEQ ID NO: 421 |
| SCW48 | At Polypeptide | SEQ ID NO: 341 |
| | At Polynucleotide transcript | SEQ ID NO: 342 |
| | Mt Polypeptide | SEQ ID NO: 343 |
| | Mt Polynucleotide transcript | SEQ ID NO: 344 |
| | Os Polypeptide | SEQ ID NO: 345 |
| | Os Polynucleotide transcript | SEQ ID NO: 346 |
| | Pt Polypeptide | SEQ ID NO: 347 |
| | Pt Polynucleotide transcript | SEQ ID NO: 348 |
| SCW49 | At Polypeptide | SEQ ID NO: 349 |
| | At Polynucleotide transcript | SEQ ID NO: 350 |
| | Os Polypeptide | SEQ ID NO: 351 |
| | Os Polynucleotide transcript | SEQ ID NO: 352 |
| SCW50 | At Polypeptide | SEQ ID NO: 353 |
| | At Polynucleotide transcript | SEQ ID NO: 354 |
| | Mt Polypeptide | SEQ ID NO: 355 |
| | Mt Polynucleotide transcript | SEQ ID NO: 356 |
| | Os Polypeptide | SEQ ID NO: 357 |
| | Os Polynucleotide transcript | SEQ ID NO: 358 |
| | Pt1 Polypeptide | SEQ ID NO: 359 |
| | Pt1 Polynucleotide transcript | SEQ ID NO: 360 |
| | Pt2 Polypeptide | SEQ ID NO: 361 |
| | Pt2 Polynucleotide transcript | SEQ ID NO: 362 |
| | Sb Polynucleotide transcript | SEQ ID NO: 422 |
| SCW51 | At Polypeptide | SEQ ID NO: 363 |
| | At Polynucleotide transcript | SEQ ID NO: 364 |
| | Mt Polypeptide | SEQ ID NO: 365 |
| | Mt Polynucleotide transcript | SEQ ID NO: 366 |
| | Os Polypeptide | SEQ ID NO: 367 |
| | Os Polynucleotide transcript | SEQ ID NO: 368 |
| | Pt Polypeptide | SEQ ID NO: 369 |
| | Pt Polynucleotide transcript | SEQ ID NO: 370 |
| SCW53 | At1 Polypeptide | SEQ ID NO: 371 |
| | At1 Polynucleotide transcript | SEQ ID NO: 372 |
| | At2 Polypeptide | SEQ ID NO: 373 |
| | At2 Polynucleotide transcript | SEQ ID NO: 374 |
| | Mt Polypeptide | SEQ ID NO: 375 |
| | Mt Polynucleotide transcript | SEQ ID NO: 376 |
| | Os1 Polypeptide | SEQ ID NO: 377 |
| | Os1 Polynucleotide transcript | SEQ ID NO: 378 |
| | Os2 Polypeptide | SEQ ID NO: 379 |
| | Os2 Polynucleotide transcript | SEQ ID NO: 380 |
| | Pt Polypeptide | SEQ ID NO: 381 |
| | Pt Polynucleotide transcript | SEQ ID NO: 382 |
| | Sb Polynucleotide transcript | SEQ ID NO: 423 |
| SCW54 | At Polypeptide | SEQ ID NO: 383 |
| | At Polynucleotide transcript | SEQ ID NO: 384 |
| | Os Polypeptide | SEQ ID NO: 385 |
| | Os Polynucleotide transcript | SEQ ID NO: 386 |
| SCW55 | At Polypeptide | SEQ ID NO: 387 |
| | At Polynucleotide transcript | SEQ ID NO: 388 |
| | Os1 Polypeptide | SEQ ID NO: 389 |
| | Os1 Polynucleotide transcript | SEQ ID NO: 390 |
| | Os2 Polypeptide | SEQ ID NO: 391 |
| | Os2 Polynucleotide transcript | SEQ ID NO: 392 |
| | Pt Polypeptide | SEQ ID NO: 393 |
| | Pt Polynucleotide transcript | SEQ ID NO: 394 |
| | Sb Polypeptide | SEQ ID NO: 395 |
| | Sb Polynucleotide transcript | SEQ ID NO: 396 |
| SCW56 | Os Polypeptide | SEQ ID NO: 397 |
| | Os Polynucleotide transcript | SEQ ID NO: 398 |
| | Sb Polypeptide | SEQ ID NO: 399 |
| | Sb Polynucleotide transcript | SEQ ID NO: 400 |
| SCW58 | At1 Polypeptide | SEQ ID NO: 401 |
| | At1 Polynucleotide transcript | SEQ ID NO: 402 |
| | At2 Polypeptide | SEQ ID NO: 403 |
| | At2 Polynucleotide transcript | SEQ ID NO: 404 |
| | Os Polypeptide | SEQ ID NO: 405 |
| | Os Polynucleotide transcript | SEQ ID NO: 406 |
| | Pt1 Polypeptide | SEQ ID NO: 407 |
| | Pt1 Polynucleotide transcript | SEQ ID NO: 408 |
| | Pt2 Polypeptide | SEQ ID NO: 409 |
| | Pt2 Polynucleotide transcript | SEQ ID NO: 410 |
| | Sb Polynucleotide transcript | SEQ ID NO: 424 |

Construction of Nucleic Acids

The isolated nucleic acids of the present invention can be made using (a) standard recombinant methods, (b) synthetic techniques, or combinations thereof. In some embodiments, the polynucleotides of the present invention will be cloned, amplified, or otherwise constructed from a fungus or bacteria.

The nucleic acids may conveniently comprise sequences in addition to a polynucleotide of the present invention. For example, a multi-cloning site comprising one or more endonuclease restriction sites may be inserted into the nucleic acid to aid in isolation of the polynucleotide. Also, translatable sequences may be inserted to aid in the isolation of the translated polynucleotide of the present invention. For example, a hexa-histidine marker sequence provides a convenient means to purify the proteins of the present invention. The nucleic acid of the present invention—excluding the polynucleotide sequence—is optionally a vector, adapter, or linker for cloning and/or expression of a polynucleotide of the present invention. Additional sequences may be added to such cloning and/or expression sequences to optimize their function in cloning and/or expression, to aid in isolation of the polynucleotide, or to improve the introduction of the polynucleotide into a cell. Typically, the length of a nucleic acid of the present invention less the length of its polynucleotide of the present invention is less than 20 kilobase pairs, often less than 15 kb, and frequently less than 10 kb. Use of cloning vectors, expression vectors, adapters, and linkers is well known in the art. Exemplary nucleic acids include such vectors as: M13, lambda ZAP Express, lambda ZAP II, lambda gt10, lambda gt11, pBK-CMV, pBK-RSV, pBluescript II, lambda DASH II, lambda EMBL 3, lambda EMBL 4, pWE15, SuperCos 1, SurfZap, Uni-ZAP, pBC, pBS+/−, pSG5, pBK, pCR-Script, pET, pSPUTK, p3'SS, pGEM, pSK+/−, pGEX, pSPORTI and II, pOPRSVI CAT, pOPI3 CAT, pXT1, pSG5, pPbac, pMbac, pMC1neo, pOG44, pOG45, pFRTβGAL, pNEOβ-GAL, pRS403, pRS404, pRS405, pRS406, pRS413, pRS414, pRS415, pRS416, lambda MOSSlox, and lambda MOSElox. Optional vectors for the present invention, include but are not limited to, lambda ZAP II, and pGEX. For a description of various nucleic acids see, e.g., Stratagene Cloning Systems, Catalogs 1995, 1996, 1997 (La Jolla, Calif.); and, Amersham Life Sciences, Inc, Catalog '97 (Arlington Heights, Ill.).

Synthetic Methods for Constructing Nucleic Acids

The isolated nucleic acids of the present invention can also be prepared by direct chemical synthesis by methods such as the phosphotriester method of Narang, et al., (1979) *Meth. Enzymol.* 68:90-9; the phosphodiester method of Brown, et al., (1979) *Meth. Enzymol.* 68:109-51; the diethylphosphoramidite method of Beaucage, et al., (1981) *Tetra. Letts.* 22(20): 1859-62; the solid phase phosphoramidite triester method described by Beaucage, et al., supra, e.g., using an automated synthesizer, e.g., as described in Needham-VanDevanter, et al., (1984) *Nucleic Acids Res.* 12:6159-68; and, the solid support method of U.S. Pat. No. 4,458,066. Chemical synthesis generally produces a single stranded oligonucleotide. This may be converted into double stranded DNA by hybridization with a complementary sequence or by polymerization with a DNA polymerase using the single strand as a template. One of skill will recognize that while chemical synthesis of DNA is limited to sequences of about 100 bases, longer sequences may be obtained by the ligation of shorter sequences.

UTRs and Codon Preference

In general, translational efficiency has been found to be regulated by specific sequence elements in the 5' non-coding or untranslated region (5' UTR) of the RNA. Positive sequence motifs include translational initiation consensus sequences (Kozak, (1987) *Nucleic Acids Res.* 15:8125) and the 5<G>7 methyl GpppG RNA cap structure (Drummond, et al., (1985) *Nucleic Acids Res.* 13:7375). Negative elements include stable intramolecular 5' UTR stem-loop structures (Muesing, et al., (1987) *Cell* 48:691) and AUG sequences or short open reading frames preceded by an appropriate AUG in the 5' UTR (Kozak, supra, Rao, et al., (1988) *Mol. and Cell. Biol.* 8:284). Accordingly, the present invention provides 5' and/or 3' UTR regions for modulation of translation of heterologous coding sequences.

Further, the polypeptide-encoding segments of the polynucleotides of the present invention can be modified to alter codon usage. Altered codon usage can be employed to alter translational efficiency and/or to optimize the coding sequence for expression in a desired host or to optimize the codon usage in a heterologous sequence for expression in maize. Codon usage in the coding regions of the polynucleotides of the present invention can be analyzed statistically using commercially available software packages such as "Codon Preference" available from the University of Wisconsin Genetics Computer Group. See, Devereaux, et al., (1984) *Nucleic Acids Res.* 12:387-395; or MacVector 4.1 (Eastman Kodak Co., New Haven, Conn.). Thus, the present invention provides a codon usage frequency characteristic of the coding region of at least one of the polynucleotides of the present invention. The number of polynucleotides (3 nucleotides per amino acid) that can be used to determine a codon usage frequency can be any integer from 3 to the number of polynucleotides of the present invention as provided herein.

Optionally, the polynucleotides will be full-length sequences. An exemplary number of sequences for statistical analysis can be at least 1, 5, 10, 20, 50 or 100.

Sequence Shuffling

The present invention provides methods for sequence shuffling using polynucleotides of the present invention, and compositions resulting therefrom. Sequence shuffling is described in PCT publication number 96/19256. See also, Zhang, et al., (1997) *Proc. Natl. Acad. Sci. USA* 94:4504-9; and Zhao, et al., (1998) *Nature Biotech* 16:258-61. Generally, sequence shuffling provides a means for generating libraries of polynucleotides having a desired characteristic, which can be selected or screened for. Libraries of recombinant polynucleotides are generated from a population of related sequence polynucleotides, which comprise sequence regions, which have substantial sequence identity and can be homologously recombined in vitro or in vivo. The population of sequence-recombined polynucleotides comprises a subpopulation of polynucleotides which possess desired or advantageous characteristics and which can be selected by a suitable selection or screening method. The characteristics can be any property or attribute capable of being selected for or detected in a screening system, and may include properties of: an encoded protein, a transcriptional element, a sequence controlling transcription, RNA processing, RNA stability, chromatin conformation, translation, or other expression property of a gene or transgene, a replicative element, a protein-binding element, or the like, such as any feature which confers a selectable or detectable property. In some embodiments, the selected characteristic will be an altered $K_m$ and/or $K_{cat}$ over the wild-type protein as provided herein. In other embodiments, a protein or polynucleotide generated from sequence shuffling will have a ligand binding affinity greater than the non-shuffled wild-type polynucleotide. In yet other embodiments, a protein or polynucleotide generated from sequence shuffling will have an altered pH optimum as compared to the non-shuffled wild-type polynucleotide. The increase in such properties can be at least 110%, 120%, 130%, 140% or greater than 150% of the wild-type value.

Recombinant Expression Cassettes

The present invention further provides recombinant expression cassettes comprising a nucleic acid of the present invention. A nucleic acid sequence coding for the desired polynucleotide of the present invention, for example a cDNA or a genomic sequence encoding a polypeptide long enough to code for an active protein of the present invention, can be used to construct a recombinant expression cassette which can be introduced into the desired host cell. A recombinant expression cassette will typically comprise a polynucleotide of the present invention operably linked to transcriptional initiation regulatory sequences which will direct the transcription of the polynucleotide in the intended host cell, such as tissues of a transformed plant.

For example, plant expression vectors may include (1) a cloned plant gene under the transcriptional control of 5' and 3' regulatory sequences and (2) a dominant selectable marker. Such plant expression vectors may also contain, if desired, a promoter regulatory region (e.g., one conferring inducible or constitutive, environmentally- or developmentally-regulated, or cell- or tissue-specific/selective expression), a transcription initiation start site, a ribosome binding site, an RNA processing signal, a transcription termination site, and/or a polyadenylation signal.

A plant promoter fragment can be employed which will direct expression of a polynucleotide of the present invention in all tissues of a regenerated plant. Such promoters are referred to herein as "constitutive" promoters and are active under most environmental conditions and states of development or cell differentiation. Examples of constitutive promoters include the 1'- or 2'-promoter derived from T-DNA of *Agrobacterium tumefaciens*, the Smas promoter, the cinnamyl alcohol dehydrogenase promoter (U.S. Pat. No. 5,683, 439), the Nos promoter, the rubisco promoter, the GRP1-8 promoter, the 35S promoter from cauliflower mosaic virus (CaMV), as described in Odell, et al., (1985) *Nature* 313:810-2; rice actin (McElroy, et al., (1990) *Plant Cell* 163-171); ubiquitin (Christensen, et al., (1992) *Plant Mol. Biol.* 12:619-632, and Christensen, et al., (1992) *Plant Mol. Biol.* 18:675-89); pEMU (Last, et al., (1991) *Theor. Appl. Genet.* 81:581-8); MAS (Velten, et al., (1984) *EMBO J.* 3:2723-30); and maize H3 histone (Lepetit, et al., (1992) *Mol. Gen. Genet.* 231:276-85; and Atanassvoa, et al., (1992) *Plant Journal* 2(3):291-300); ALS promoter, as described in PCT Application No. WO 96/30530; GOS2 (U.S. Pat. No. 6,504,083) and other transcription initiation regions from various plant genes known to those of skill. For the present invention ubiquitin is the preferred promoter for expression in monocot plants.

Alternatively, the plant promoter can direct expression of a polynucleotide of the present invention in a specific tissue or may be otherwise under more precise environmental or developmental control. Such promoters are referred to here as "inducible" promoters (Rab17, RAD29). Environmental conditions that may effect transcription by inducible promoters include pathogen attack, anaerobic conditions, or the presence of light. Examples of inducible promoters are the Adh1 promoter, which is inducible by hypoxia or cold stress, the Hsp70 promoter, which is inducible by heat stress, and the PPDK promoter, which is inducible by light.

Examples of promoters under developmental control include promoters that initiate transcription only, or preferentially, in certain tissues, such as leaves, roots, fruit, seeds, or flowers. The operation of a promoter may also vary depending on its location in the genome. Thus, an inducible promoter may become fully or partially constitutive in certain locations.

If polypeptide expression is desired, it is generally desirable to include a polyadenylation region at the 3'-end of a polynucleotide coding region. The polyadenylation region can be derived from a variety of plant genes, or from T-DNA. The 3' end sequence to be added can be derived from, for example, the nopaline synthase or octopine synthase genes, or alternatively from another plant gene, or less preferably from any other eukaryotic gene. Examples of such regulatory elements include, but are not limited to, 3' termination and/or polyadenylation regions such as those of the *Agrobacterium tumefaciens* nopaline synthase (nos) gene (Bevan, et al., (1983) *Nucleic Acids Res.* 12:369-85); the potato proteinase inhibitor II (PINII) gene (Keil, et al., (1986) *Nucleic Acids Res.* 14:5641-50; and An, et al., (1989) *Plant Cell* 1:115-22); and the CaMV 19S gene (Mogen, et al., (1990) *Plant Cell* 2:1261-72).

An intron sequence can be added to the 5' untranslated region or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg, (1988) *Mol. Cell. Biol.* 8:4395-4405; Callis, et al., (1987) *Genes Dev.* 1:1183-200). Such intron enhancement of gene expression is typically greatest when placed near the 5' end of the transcription unit. Use of maize introns Adh1-S intron 1, 2, and 6, the Bronze-1 intron are known in the art. See generally, THE MAIZE HANDBOOK, Chapter 116, Freeling and Walbot, eds., Springer, New York. (1994).

Plant signal sequences, including, but not limited to, signal-peptide encoding DNA/RNA sequences which target proteins to the extracellular matrix of the plant cell (Dratewka-Kos, et al., (1989) *J. Biol. Chem.* 264:4896-900), such as the *Nicotiana plumbaginifolia* extension gene (DeLoose, et al., (1991) *Gene* 99:95-100); signal peptides which target proteins to the vacuole, such as the sweet potato sporamin gene (Matsuka, et al., (1991) *Proc. Natl. Acad. Sci. USA* 88:834) and the barley lectin gene (Wilkins, et al., (1990) *Plant Cell,* 2:301-13); signal peptides which cause proteins to be secreted, such as that of PRIb (Lind, et al., (1992) *Plant Mol. Biol.* 18:47-53) or the barley alpha amylase (BAA) (Rahmatullah, et al., (1989) *Plant Mol. Biol.* 12:119, and hereby incorporated by reference), or signal peptides which target proteins to the plastids such as that of rapeseed enoyl-Acp reductase (Verwaert, et al., (1994) *Plant Mol. Biol.* 26:189-202) are useful in the invention. The barley alpha amylase signal sequence fused to the SCW polynucleotide is the preferred construct for expression in maize for the present invention.

The vector comprising the sequences from a polynucleotide of the present invention will typically comprise a marker gene, which confers a selectable phenotype on plant cells. Usually, the selectable marker gene will encode antibiotic resistance, with suitable genes including genes coding for resistance to the antibiotic spectinomycin (e.g., the aada gene), the streptomycin phosphotransferase (SPT) gene coding for streptomycin resistance, the neomycin phosphotransferase (NPTII) gene encoding kanamycin or geneticin resistance, the hygromycin phosphotransferase (HPT) gene coding for hygromycin resistance, genes coding for resistance to herbicides which act to inhibit the action of acetolactate synthase (ALS), in particular the sulfonylurea-type herbicides (e.g., the acetolactate synthase (ALS) gene containing mutations leading to such resistance in particular the S4 and/or Hra mutations), genes coding for resistance to herbicides which act to inhibit action of glutamine synthase, such as phosphinothricin or basta (e.g., the bar gene), or other such genes known in the art. The bar gene encodes resistance to the herbicide basta, and the ALS gene encodes resistance to the herbicide chlorsulfuron.

Typical vectors useful for expression of genes in higher plants are well known in the art and include vectors derived from the tumor-inducing (Ti) plasmid of *Agrobacterium tumefaciens* described by Rogers, et al., (1987) *Meth. Enzymol.* 153:253-77. These vectors are plant integrating vectors in that on transformation, the vectors integrate a portion of vector DNA into the genome of the host plant. Exemplary *A. tumefaciens* vectors useful herein are plasmids pKYLX6 and pKYLX7 of Schardl, et al., (1987) *Gene* 61:1-11, and Berger, et al., (1989) *Proc. Natl. Acad. Sci. USA,* 86:8402-6. Another useful vector herein is plasmid pBI101.2 that is available from CLONTECH Laboratories, Inc. (Palo Alto, Calif.).

Expression of Proteins in Host Cells

Using the nucleic acids of the present invention, one may express a protein of the present invention in a recombinantly engineered cell such as bacteria, yeast, insect, mammalian, or preferably plant cells. The cells produce the protein in a non-natural condition (e.g., in quantity, composition, location, and/or time), because they have been genetically altered through human intervention to do so.

It is expected that those of skill in the art are knowledgeable in the numerous expression systems available for expression of a nucleic acid encoding a protein of the present invention.

No attempt to describe in detail the various methods known for the expression of proteins in prokaryotes or eukaryotes will be made.

In brief summary, the expression of isolated nucleic acids encoding a protein of the present invention will typically be achieved by operably linking, for example, the DNA or cDNA to a promoter (which is either constitutive or inducible), followed by incorporation into an expression vector. The vectors can be suitable for replication and integration in either prokaryotes or eukaryotes. Typical expression vectors contain transcription and translation terminators, initiation sequences, and promoters useful for regulation of the expression of the DNA encoding a protein of the present invention. To obtain high level expression of a cloned gene, it is desirable to construct expression vectors which contain, at the minimum, a strong promoter, such as ubiquitin, to direct transcription, a ribosome binding site for translational initiation, and a transcription/translation terminator. Constitutive promoters are classified as providing for a range of constitutive expression. Thus, some are weak constitutive promoters, and others are strong constitutive promoters. Generally, by "weak promoter" is intended a promoter that drives expression of a coding sequence at a low level. By "low level" is intended at levels of about 1/10,000 transcripts to about 1/100,000 transcripts to about 1/500,000 transcripts. Conversely, a "strong promoter" drives expression of a coding sequence at a "high level," or about 1/10 transcripts to about 1/100 transcripts to about 1/1,000 transcripts.

One of skill would recognize that modifications could be made to a protein of the present invention without diminishing its biological activity. Some modifications may be made to facilitate the cloning, expression, or incorporation of the targeting molecule into a fusion protein. Such modifications are well known to those of skill in the art and include, for example, a methionine added at the amino terminus to provide an initiation site, or additional amino acids (e.g., poly His) placed on either terminus to create conveniently located restriction sites or termination codons or purification sequences.

Expression in Prokaryotes

Prokaryotic cells may be used as hosts for expression. Prokaryotes most frequently are represented by various strains of *E. coli*; however, other microbial strains may also be used. Commonly used prokaryotic control sequences which are defined herein to include promoters for transcription initiation, optionally with an operator, along with ribosome binding site sequences, include such commonly used promoters as the beta lactamase (penicillinase) and lactose (lac) promoter systems (Chang, et al., (1977) *Nature* 198:1056), the tryptophan (trp) promoter system (Goeddel, et al., (1980) *Nucleic Acids Res.* 8:4057) and the lambda derived P L promoter and N-gene ribosome binding site (Shimatake, et al., (1981) *Nature* 292:128). The inclusion of selection markers in DNA vectors transfected in *E. coli* is also useful. Examples of such markers include genes specifying resistance to ampicillin, tetracycline, or chloramphenicol.

The vector is selected to allow introduction of the gene of interest into the appropriate host cell. Bacterial vectors are typically of plasmid or phage origin. Appropriate bacterial cells are infected with phage vector particles or transfected with naked phage vector DNA. If a plasmid vector is used, the bacterial cells are transfected with the plasmid vector DNA. Expression systems for expressing a protein of the present invention are available using *Bacillus* sp. and *Salmonella* (Palva, et al., (1983) *Gene* 22:229-35; Mosbach, et al., (1983) *Nature* 302:543-5). The pGEX-4T-1 plasmid vector from Pharmacia is the preferred *E. coli* expression vector for the present invention.

Expression in Eukaryotes

A variety of eukaryotic expression systems such as yeast, insect cell lines, plant and mammalian cells, are known to those of skill in the art. As explained briefly below, the present invention can be expressed in these eukaryotic systems. In some embodiments, transformed/transfected plant cells, as discussed infra, are employed as expression systems for production of the proteins of the instant invention.

Synthesis of heterologous proteins in yeast is well known. Sherman, et al., (1982) METHODS IN YEAST GENETICS, Cold Spring Harbor Laboratory is a well recognized work describing the various methods available to produce the protein in yeast. Two widely utilized yeasts for production of eukaryotic proteins are *Saccharomyces cerevisiae* and *Pichia pastoris*. Vectors, strains, and protocols for expression in *Saccharomyces* and *Pichia* are known in the art and available from commercial suppliers (e.g., Invitrogen). Suitable vectors usually have expression control sequences, such as promoters, including 3-phosphoglycerate kinase or alcohol oxidase, and an origin of replication, termination sequences and the like as desired.

A protein of the present invention, once expressed, can be isolated from yeast by lysing the cells and applying standard protein isolation techniques to the lysates or the pellets. The monitoring of the purification process can be accomplished by using Western blot techniques or radioimmunoassay of other standard immunoassay techniques.

The sequences encoding proteins of the present invention can also be ligated to various expression vectors for use in transfecting cell cultures of, for instance, mammalian, insect, or plant origin. Mammalian cell systems often will be in the form of monolayers of cells although mammalian cell suspensions may also be used. A number of suitable host cell lines capable of expressing intact proteins have been developed in the art, and include the HEK293, BHK21, and CHO cell lines. Expression vectors for these cells can include expression control sequences, such as an origin of replication, a promoter (e.g., the CMV promoter, a HSV tk promoter or pgk (phosphoglycerate kinase) promoter), an enhancer (Queen, et al., (1986) *Immunol. Rev.* 89:49), and necessary processing information sites, such as ribosome binding sites, RNA splice sites, polyadenylation sites (e.g., an SV40 large T Ag poly A addition site), and transcriptional terminator sequences. Other animal cells useful for production of proteins of the present invention are available, for instance, from the American Type Culture Collection Catalogue of Cell Lines and Hybridomas (7th ed., 1992).

Appropriate vectors for expressing proteins of the present invention in insect cells are usually derived from the SF9 baculovirus. Suitable insect cell lines include mosquito larvae, silkworm, armyworm, moth, and *Drosophila* cell lines such as a Schneider cell line (see, e.g., Schneider, (1987) *J. Embryol. Exp. Morphol.* 27:353-65).

As with yeast, when higher animal or plant host cells are employed, polyadenlyation or transcription terminator sequences are typically incorporated into the vector. An example of a terminator sequence is the polyadenlyation sequence from the bovine growth hormone gene. Sequences for accurate splicing of the transcript may also be included. An example of a splicing sequence is the VP1 intron from SV40 (Sprague, et al., (1983) *J. Virol.* 45:773-81). Additionally, gene sequences to control replication in the host cell may be incorporated into the vector such as those found in bovine papilloma virus type-vectors (Saveria-Campo, "Bovine Papilloma Virus DNA a Eukaryotic Cloning Vector," in DNA CLONING: A PRACTICAL APPROACH, vol. II, Glover, ed., IRL Press, Arlington, Va., pp. 213-38 (1985)).

In addition, the gene for SCW placed in the appropriate plant expression vector can be used to transform plant cells. The polypeptide can then be isolated from plant callus or the transformed cells can be used to regenerate transgenic plants. Such transgenic plants can be harvested, and the appropriate tissues (seed or leaves, for example) can be subjected to large scale protein extraction and purification techniques.

Plant Transformation Methods

Numerous methods for introducing foreign genes into plants are known and can be used to insert a SCW polynucleotide into a plant host, including biological and physical plant transformation protocols. See, e.g., Miki, et al., "Procedure for Introducing Foreign DNA into Plants," in METHODS IN PLANT MOLECULAR BIOLOGY AND BIOTECHNOLOGY, Glick and Thompson, eds., CRC Press, Inc., Boca Raton, pp. 67-88 (1993). The methods chosen vary with the host plant, and include chemical transfection methods such as calcium phosphate, microorganism-mediated gene transfer such as *Agrobacterium* (Horsch, et al., (1985) *Science* 227: 1229-31), electroporation, micro-injection, and biolistic bombardment.

Expression cassettes and vectors and in vitro culture methods for plant cell or tissue transformation and regeneration of plants are known and available. See, e.g., Gruber, et al., "Vectors for Plant Transformation," in METHODS IN PLANT MOLECULAR BIOLOGY AND BIOTECHNOLOGY, supra, pp. 89-119.

The isolated polynucleotides or polypeptides may be introduced into the plant by one or more techniques typically used for direct delivery into cells. Such protocols may vary depending on the type of organism, cell, plant or plant cell, i.e., monocot or dicot, targeted for gene modification. Suitable methods of transforming plant cells include microinjection (Crossway, et al., (1986) *Biotechniques* 4:320-334; and U.S. Pat. No. 6,300,543), electroporation (Riggs, et al., (1986) *Proc. Natl. Acad. Sci. USA* 83:5602-5606, direct gene transfer (Paszkowski, et al., (1984) *EMBO J.* 3:2717-2722), and ballistic particle acceleration (see, for example, Sanford, et al., U.S. Pat. No. 4,945,050; WO 91/10725; and McCabe, et al., (1988) *Biotechnology* 6:923-926). Also see, Tomes, et al., Direct DNA Transfer into Intact Plant Cells Via Microprojectile Bombardment. pp. 197-213 in *Plant Cell, Tissue and Organ Culture, Fundamental Methods* eds. O. L. Gamborg & G. C. Phillips, Springer-Verlag Berlin Heidelberg N.Y., 1995; U.S. Pat. No. 5,736,369 (meristem); Weissinger, et al., (1988) *Ann. Rev. Genet.* 22:421-477; Sanford, et al., (1987) *Particulate Science and Technology* 5:27-37 (onion); Christou, et al., (1988) *Plant Physiol.* 87:671-674 (soybean); Datta, et al., (1990) *Biotechnology* 8:736-740 (rice); Klein, et al., (1988) *Proc. Natl. Acad. Sci. USA* 85:4305-4309 (maize); Klein, et al., (1988) *Biotechnology* 6:559-563 (maize); WO 91/10725 (maize); Klein, et al., (1988) *Plant Physiol.* 91:440-444 (maize); Fromm, et al., (1990) *Biotechnology* 8:833-839; and Gordon-Kamm, et al., (1990) *Plant Cell* 2:603-618 (maize); Hooydaas-Van Slogteren & Hooykaas (1984) *Nature* (London) 311:763-764; Bytebier, et al., (1987) *Proc. Natl. Acad. Sci. USA* 84:5345-5349 (Liliaceae); De Wet, et al., (1985) In The Experimental Manipulation of Ovule Tissues. ed. G. P. Chapman, et al., pp. 197-209; Longman, N.Y. (pollen); Kaeppler, et al., (1990) *Plant Cell Reports* 9:415-418; and Kaeppler, et al., (1992) *Theor. Appl. Genet.* 84:560-566 (whisker-mediated transformation); U.S. Pat. No. 5,693,512 (sonication); D'Halluin, et al., (1992) *Plant Cell* 4:1495-1505 (electroporation); Li, et al., (1993) *Plant Cell Reports* 12:250-255; and Christou and Ford (1995) *Annals of Botany* 75:407-413 (rice); Osjoda, et al., (1996) *Nature Biotech.* 14:745-750; *Agrobacterium* mediated maize transformation (U.S. Pat. No. 5,981,840); silicon carbide whisker methods (Frame, et al., (1994) *Plant J.* 6:941-948); laser methods (Guo, et al., (1995) *Physiologia Plantarum* 93:19-24); sonication methods (Bao, et al., (1997) *Ultrasound in Medicine & Biology* 23:953-959; Finer and Finer (2000) *Lett Appl Microbiol.* 30:406-10; Amoah, et al., (2001) *J Exp Bot* 52:1135-42); polyethylene glycol methods (Krens, et al., (1982) *Nature* 296:72-77); protoplasts of monocot and dicot cells can be transformed using electroporation (Fromm, et al., (1985) *Proc. Natl. Acad. Sci. USA* 82:5824-5828) and microinjection (Crossway, et al., (1986) *Mol. Gen. Genet.* 202:179-185); all of which are herein incorporated by reference.

*Agrobacterium*-Mediated Transformation

The most widely utilized method for introducing an expression vector into plants is based on the natural transformation system of *Agrobacterium*. *A. tumefaciens* and *A. rhizogenes* are plant pathogenic soil bacteria, which genetically transform plant cells. The Ti and Ri plasmids of *A. tumefaciens* and *A. rhizogenes*, respectively, carry genes responsible for genetic transformation of plants. See, e.g., Kado, (1991) *Crit. Rev. Plant Sci.* 10:1. Descriptions of the *Agrobacterium* vector systems and methods for *Agrobacterium*-mediated gene transfer are provided in Gruber, et al., supra; Miki, et al., supra; and Moloney, et al., (1989) *Plant Cell Reports* 8:238.

Similarly, the gene can be inserted into the T-DNA region of a Ti or Ri plasmid derived from *A. tumefaciens* or *A. rhizogenes*, respectively. Thus, expression cassettes can be constructed as above, using these plasmids. Many control sequences are known which when coupled to a heterologous coding sequence and transformed into a host organism show fidelity in gene expression with respect to tissue/organ specificity of the original coding sequence. See, e.g., Benfey and Chua, (1989) *Science* 244:174-81. Particularly suitable control sequences for use in these plasmids are promoters for constitutive leaf-specific expression of the gene in the various target plants. Other useful control sequences include a promoter and terminator from the nopaline synthase gene (NOS). The NOS promoter and terminator are present in the plasmid pARC2, available from the American Type Culture Collection and designated ATCC 67238. If such a system is used, the virulence (vir) gene from either the Ti or Ri plasmid must also be present, either along with the T-DNA portion, or via a binary system where the vir gene is present on a separate vector. Such systems, vectors for use therein, and methods of transforming plant cells are described in U.S. Pat. No. 4,658,082; U.S. patent application Ser. No. 913,914, filed Oct. 1, 1986, as referenced in U.S. Pat. No. 5,262,306, issued Nov. 16, 1993; and Simpson, et al., (1986) *Plant Mol. Biol.* 6:403-15 (also referenced in the '306 patent); all incorporated by reference in their entirety.

Once constructed, these plasmids can be placed into *A. rhizogenes* or *A. tumefaciens* and these vectors used to transform cells of plant species, which are ordinarily susceptible to *Fusarium* or *Alternaria* infection. Several other transgenic plants are also contemplated by the present invention including but not limited to soybean, corn, sorghum, alfalfa, rice, clover, cabbage, banana, coffee, celery, tobacco, cowpea, cotton, melon and pepper. The selection of either *A. tumefaciens* or *A. rhizogenes* will depend on the plant being transformed thereby. In general *A. tumefaciens* is the preferred organism for transformation. Most dicotyledonous plants, some gymnosperms, and a few monocotyledonous plants (e.g., certain members of the Liliales and Arales) are susceptible to infection with *A. tumefaciens*. *A. rhizogenes* also has a wide host range, embracing most dicots and some gymnosperms, which includes members of the Leguminosae, Compositae, and Chenopodiaceae. Monocot plants can now be transformed with some success. EP Application Number 604 662 A1 discloses a method for transforming monocots using *Agrobacterium*. EP Application Number 672 752 A1 discloses a method for transforming monocots with *Agrobacterium* using the scutellum of immature embryos. Ishida, et al., discuss a method for transforming maize by exposing immature embryos to *A. tumefaciens* (*Nature Biotechnology* 14:745-50 (1996)).

Once transformed, these cells can be used to regenerate transgenic plants. For example, whole plants can be infected with these vectors by wounding the plant and then introducing the vector into the wound site. Any part of the plant can be wounded, including leaves, stems and roots. Alternatively, plant tissue, in the form of an explant, such as cotyledonary tissue or leaf disks, can be inoculated with these vectors, and cultured under conditions, which promote plant regeneration. Roots or shoots transformed by inoculation of plant tissue with *A. rhizogenes* or *A. tumefaciens*, containing the gene coding for the fumonisin degradation enzyme, can be used as a source of plant tissue to regenerate fumonisin-resistant transgenic plants, either via somatic embryogenesis or organogenesis. Examples of such methods for regenerating plant tissue are disclosed in Shahin, *Theor. Appl. Genet.* 69:235-40 (1985); U.S. Pat. No. 4,658,082; Simpson, et al., supra; and U.S. patent application Ser. Nos. 913,913 and 913,914, both filed Oct. 1, 1986, as referenced in U.S. Pat. No. 5,262,306, issued Nov. 16, 1993, the entire disclosures therein incorporated herein by reference.

Direct Gene Transfer

Despite the fact that the host range for *Agrobacterium*-mediated transformation is broad, some major cereal crop species and gymnosperms have generally been recalcitrant to this mode of gene transfer, even though some success has recently been achieved in rice (Hiei, et al., (1994) *The Plant Journal* 6:271-82). Several methods of plant transformation, collectively referred to as direct gene transfer, have been developed as an alternative to *Agrobacterium*-mediated transformation.

A generally applicable method of plant transformation is microprojectile-mediated transformation, where DNA is carried on the surface of microprojectiles measuring about 1 to 4 μm. The expression vector is introduced into plant tissues with a biolistic device that accelerates the microprojectiles to speeds of 300 to 600 m/s which is sufficient to penetrate the plant cell walls and membranes (Sanford, et al., (1987) *Part. Sci. Technol.* 5:27; Sanford, (1988) *Trends Biotech* 6:299; Sanford, (1990) *Physiol. Plant* 79:206; and Klein, et al., (1992) *Biotechnology* 10:268).

Another method for physical delivery of DNA to plants is sonication of target cells as described in Zang, et al., (1991) *BioTechnology* 9:996. Alternatively, liposome or spheroplast fusions have been used to introduce expression vectors into plants. See, e.g., Deshayes, et al., (1985) *EMBO J.* 4:2731; and Christou, et al., (1987) *Proc. Natl. Acad. Sci. USA* 84:3962. Direct uptake of DNA into protoplasts using $CaCl_2$ precipitation, polyvinyl alcohol, or poly-L-ornithine has also been reported. See, e.g., Hain, et al., (1985) *Mol. Gen. Genet.* 199:161; and Draper, et al., (1982) *Plant Cell Physiol.* 23:451.

Electroporation of protoplasts and whole cells and tissues has also been described. See, e.g., Donn, et al., (1990) in *Abstracts of the VIIth Int'l. Congress on Plant Cell and Tissue Culture IAPTC*, A2-38, p. 53; D'Halluin, et al., (1992) *Plant Cell* 4:1495-505; and Spencer, et al., (1994) *Plant Mol. Biol.* 24:51-61.

Increasing the Activity and/or Level of a SCW Polypeptide

Methods are provided to increase the activity and/or level of the SCW polypeptide of the invention. An increase in the level and/or activity of the SCW polypeptide of the invention can be achieved by providing to the plant an SCW polypeptide. The SCW polypeptide can be provided by introducing the amino acid sequence encoding the SCW polypeptide into the plant, introducing into the plant a nucleotide sequence encoding an SCW polypeptide or alternatively by selecting for different variants of the genomic locus encoding the SCW polypeptide of the invention.

As discussed elsewhere herein, many methods are known the art for providing a polypeptide to a plant including, but not limited to, direct introduction of the polypeptide into the plant, introducing into the plant (transiently or stably) a polynucleotide construct encoding a polypeptide having secondary cell wall development activity. It is also recognized that the methods of the invention may employ a polynucleotide that is not capable of directing, in the transformed plant, the expression of a protein or an RNA. Thus, the level and/or activity of an SCW polypeptide may be increased by altering the gene encoding the SCW polypeptide or its promoter. See, e.g., Kmiec, U.S. Pat. No. 5,565,350; Zarling, et al., PCT/US93/03868. Therefore mutagenized plants that carry mutations in SCW genes, where the mutations increase expression of the SCW gene or increase the plant growth and/or secondary cell wall development activity of the encoded SCW polypeptide are provided.

Reducing the Activity and/or Level of a SCW Polypeptide

Methods are provided to reduce or eliminate the activity of an SCW polypeptide of the invention by transforming a plant cell with an expression cassette that expresses a polynucleotide that inhibits the expression of the SCW polypeptide. The polynucleotide may inhibit the expression of the SCW polypeptide directly, by preventing translation of the SCW messenger RNA, or indirectly, by encoding a polypeptide that inhibits the transcription or translation of a SCW gene encoding a SCW polypeptide. Methods for inhibiting or eliminating the expression of a gene in a plant are well known in the art, and any such method may be used in the present invention to inhibit the expression of an SCW polypeptide.

In accordance with the present invention, the expression of a SCW polypeptide is inhibited if the protein level of the SCW polypeptide is less than 70% of the protein level of the same SCW polypeptide in a plant that has not been genetically modified or mutagenized to inhibit the expression of that SCW polypeptide. In particular embodiments of the invention, the protein level of the SCW polypeptide in a modified plant according to the invention is less than 60%, less than 50%, less than 40%, less than 30%, less than 20%, less than 10%, less than 5% or less than 2% of the protein level of the same SCW polypeptide in a plant that is not a mutant or that has not been genetically modified to inhibit the expression of that SCW polypeptide. The expression level of the SCW polypeptide may be measured directly, for example, by assaying for the level of SCW polypeptide expressed in the plant cell or plant, or indirectly, for example, by measuring the plant growth and/or secondary cell wall development activity of the SCW polypeptide in the plant cell or plant, or by measuring the biomass in the plant. Methods for performing such assays are described elsewhere herein.

In other embodiments of the invention, the activity of the SCW polypeptides is reduced or eliminated by transforming a plant cell with an expression cassette comprising a polynucleotide encoding a polypeptide that inhibits the activity of a SCW polypeptide. The plant growth and/or secondary cell wall development activity of a SCW polypeptide is inhibited according to the present invention if the plant growth and/or secondary cell wall development activity of the SCW polypeptide is less than 70% of the plant growth and/or secondary cell wall development activity of the same SCW polypeptide in a plant that has not been modified to inhibit the plant growth and/or secondary cell wall development activity of that SCW polypeptide. In particular embodiments of the invention, the plant growth and/or secondary cell wall development activity of the SCW polypeptide in a modified plant according to the invention is less than 60%, less than 50%, less than 40%, less than 30%, less than 20%, less than 10%, or less than 5% of the plant growth and/or secondary cell wall development activity of the same SCW polypeptide in a plant that that has not been modified to inhibit the expression of that SCW polypeptide. The plant growth and/or secondary cell wall development activity of an SCW polypeptide is "eliminated" according to the invention when it is not detectable by the assay methods described elsewhere herein. Methods of determining the plant growth and/or secondary cell wall development activity of an SCW polypeptide are described elsewhere herein.

In other embodiments, the activity of an SCW polypeptide may be reduced or eliminated by disrupting the gene encoding the SCW polypeptide. The invention encompasses mutagenized plants that carry mutations in SCW genes, where the mutations reduce expression of the SCW gene or inhibit the plant growth and/or secondary cell wall development activity of the encoded SCW polypeptide.

Thus, many methods may be used to reduce or eliminate the activity of an SCW polypeptide. In addition, more than one method may be used to reduce the activity of a single SCW polypeptide. Non-limiting examples of methods of reducing or eliminating the expression of SCW polypeptides are given below.

1. Polynucleotide-Based Methods:

In some embodiments of the present invention, a plant is transformed with an expression cassette that is capable of expressing a polynucleotide that inhibits the expression of an SCW polypeptide of the invention. The term "expression" as used herein refers to the biosynthesis of a gene product, including the transcription and/or translation of said gene product. For example, for the purposes of the present invention, an expression cassette capable of expressing a polynucleotide that inhibits the expression of at least one SCW polypeptide is an expression cassette capable of producing an RNA molecule that inhibits the transcription and/or translation of at least one SCW polypeptide of the invention. The "expression" or "production" of a protein or polypeptide from a DNA molecule refers to the transcription and translation of the coding sequence to produce the protein or polypeptide, while the "expression" or "production" of a protein or polypeptide from an RNA molecule refers to the translation of the RNA coding sequence to produce the protein or polypeptide.

Examples of polynucleotides that inhibit the expression of an SCW polypeptide are given below.

i. Sense Suppression/Cosuppression

In some embodiments of the invention, inhibition of the expression of a SCW polypeptide may be obtained by sense suppression or cosuppression. For cosuppression, an expression cassette is designed to express an RNA molecule corresponding to all or part of a messenger RNA encoding an SCW polypeptide in the "sense" orientation. Over expression of the RNA molecule can result in reduced expression of the native gene. Accordingly, multiple plant lines transformed with the cosuppression expression cassette are screened to identify those that show the greatest inhibition of SCW polypeptide expression.

The polynucleotide used for cosuppression may correspond to all or part of the sequence encoding the SCW polypeptide, all or part of the 5' and/or 3' untranslated region of an SCW polypeptide transcript, or all or part of both the coding sequence and the untranslated regions of a transcript encoding an SCW polypeptide. In some embodiments where the polynucleotide comprises all or part of the coding region for the SCW polypeptide, the expression cassette is designed to eliminate the start codon of the polynucleotide so that no protein product will be translated.

Cosuppression may be used to inhibit the expression of plant genes to produce plants having undetectable protein levels for the proteins encoded by these genes. See, for example, Broin, et al., (2002) *Plant Cell* 14:1417-1432. Cosuppression may also be used to inhibit the expression of multiple proteins in the same plant. See, for example, U.S. Pat. No. 5,942,657. Methods for using cosuppression to inhibit the expression of endogenous genes in plants are described in Flavell, et al., (1994) *Proc. Natl. Acad. Sci. USA* 91:3490-3496; Jorgensen, et al., (1996) *Plant Mol. Biol.* 31:957-973; Johansen and Carrington (2001) *Plant Physiol.* 126:930-938; Broin, et al., (2002) *Plant Cell* 14:1417-1432; Stoutjesdijk, et al., (2002) *Plant Physiol.* 129:1723-1731; Yu, et al., (2003) *Phytochemistry* 63:753-763; and U.S. Pat. Nos. 5,034,323, 5,283,184, and 5,942,657; each of which is herein incorporated by reference. The efficiency of cosuppression may be increased by including a poly-dT region in the expression cassette at a position 3' to the sense sequence and 5' of the polyadenylation signal. See, US Patent Application Publication Number 20020048814, herein incorporated by reference. Typically, such a nucleotide sequence has substantial sequence identity to the sequence of the transcript of the endogenous gene, optimally greater than about 65% sequence identity, more optimally greater than about 85% sequence identity, most optimally greater than about 95% sequence identity. See, U.S. Pat. Nos. 5,283,184 and 5,034,323; herein incorporated by reference.

ii. Antisense Suppression

In some embodiments of the invention, inhibition of the expression of the SCW polypeptide may be obtained by antisense suppression. For antisense suppression, the expression cassette is designed to express an RNA molecule complementary to all or part of a messenger RNA encoding the SCW polypeptide. Over expression of the antisense RNA molecule can result in reduced expression of the native gene. Accordingly, multiple plant lines transformed with the antisense suppression expression cassette are screened to identify those that show the greatest inhibition of SCW polypeptide expression.

The polynucleotide for use in antisense suppression may correspond to all or part of the complement of the sequence encoding the SCW polypeptide, all or part of the complement of the 5' and/or 3' untranslated region of the SCW transcript, or all or part of the complement of both the coding sequence and the untranslated regions of a transcript encoding the SCW polypeptide. In addition, the antisense polynucleotide may be fully complementary (i.e., 100% identical to the complement of the target sequence) or partially complementary (i.e., less than 100% identical to the complement of the target sequence) to the target sequence. Antisense suppression may be used to inhibit the expression of multiple proteins in the same plant. See, for example, U.S. Pat. No. 5,942,657. Furthermore, portions of the antisense nucleotides may be used to disrupt the expression of the target gene. Generally, sequences of at least 50 nucleotides, 100 nucleotides, 200 nucleotides, 300, 400, 450, 500, 550 or greater may be used. Methods for using antisense suppression to inhibit the expression of endogenous genes in plants are described, for example, in Liu, et al., (2002) *Plant Physiol.* 129:1732-1743 and U.S. Pat. Nos. 5,759,829 and 5,942,657, each of which is herein incorporated by reference. Efficiency of antisense suppression may be increased by including a poly-dT region in the expression cassette at a position 3' to the antisense sequence and 5' of the polyadenylation signal. See, US Patent Application Publication Number 20020048814, herein incorporated by reference.

iii. Double-Stranded RNA Interference

In some embodiments of the invention, inhibition of the expression of a SCW polypeptide may be obtained by double-stranded RNA (dsRNA) interference. For dsRNA interference, a sense RNA molecule like that described above for cosuppression and an antisense RNA molecule that is fully or partially complementary to the sense RNA molecule are expressed in the same cell, resulting in inhibition of the expression of the corresponding endogenous messenger RNA.

Expression of the sense and antisense molecules can be accomplished by designing the expression cassette to comprise both a sense sequence and an antisense sequence. Alternatively, separate expression cassettes may be used for the sense and antisense sequences. Multiple plant lines transformed with the dsRNA interference expression cassette or expression cassettes are then screened to identify plant lines that show the greatest inhibition of SCW polypeptide expression. Methods for using dsRNA interference to inhibit the expression of endogenous plant genes are described in Waterhouse, et al., (1998) *Proc. Natl. Acad. Sci. USA* 95:13959-13964, Liu, et al., (2002) *Plant Physiol.* 129:1732-1743, and WO 99/49029, WO 99/53050, WO 99/61631, and WO 00/49035; each of which is herein incorporated by reference.

iv. Hairpin RNA Interference and Intron-Containing Hairpin RNA Interference

In some embodiments of the invention, inhibition of the expression of one or a SCW polypeptide may be obtained by hairpin RNA (hpRNA) interference or intron-containing hairpin RNA (ihpRNA) interference. These methods are highly efficient at inhibiting the expression of endogenous genes. See, Waterhouse and Helliwell (2003) *Nat. Rev. Genet.* 4:29-38 and the references cited therein.

For hpRNA interference, the expression cassette is designed to express an RNA molecule that hybridizes with itself to form a hairpin structure that comprises a single-stranded loop region and a base-paired stem. The base-paired stem region comprises a sense sequence corresponding to all or part of the endogenous messenger RNA encoding the gene whose expression is to be inhibited, and an antisense sequence that is fully or partially complementary to the sense sequence. Thus, the base-paired stem region of the molecule generally determines the specificity of the RNA interference. hpRNA molecules are highly efficient at inhibiting the expression of endogenous genes, and the RNA interference they induce is inherited by subsequent generations of plants. See, for example, Chuang and Meyerowitz (2000) *Proc. Natl. Acad. Sci. USA* 97:4985-4990; Stoutjesdijk, et al., (2002) *Plant Physiol.* 129:1723-1731; and Waterhouse and Helliwell (2003) *Nat. Rev. Genet.* 4:29-38. Methods for using hpRNA interference to inhibit or silence the expression of genes are described, for example, in Chuang and Meyerowitz (2000) *Proc. Natl. Acad. Sci. USA* 97:4985-4990; Stoutjesdijk, et al., (2002) *Plant Physiol.* 129:1723-1731; Waterhouse and Helliwell (2003) *Nat. Rev. Genet.* 4:29-38; Pandolfini, et al., *BMC Biotechnology* 3:7, and US Patent Application Publication Number 20030175965; each of which is herein incorporated by reference. A transient assay for the efficiency of hpRNA constructs to silence gene expression in vivo has been described by Panstruga, et al., (2003) *Mol. Biol. Rep.* 30:135-140, herein incorporated by reference.

For ihpRNA, the interfering molecules have the same general structure as for hpRNA, but the RNA molecule additionally comprises an intron that is capable of being spliced in the cell in which the ihpRNA is expressed. The use of an intron minimizes the size of the loop in the hairpin RNA molecule following splicing, and this increases the efficiency of interference. See, for example, Smith, et al., (2000) *Nature* 407:319-320. In fact, Smith, et al., show 100% suppression of endogenous gene expression using ihpRNA-mediated interference. Methods for using ihpRNA interference to inhibit the expression of endogenous plant genes are described, for example, in Smith, et al., (2000) *Nature* 407:319-320; Wesley, et al., (2001) *Plant J.* 27:581-590; Wang and Waterhouse (2001) *Curr. Opin. Plant Biol.* 5:146-150; Waterhouse and Helliwell (2003) *Nat. Rev. Genet.* 4:29-38; Helliwell and Waterhouse (2003) *Methods* 30:289-295, and US Patent Application Publication Number 20030180945, each of which is herein incorporated by reference.

The expression cassette for hpRNA interference may also be designed such that the sense sequence and the antisense sequence do not correspond to an endogenous RNA. In this embodiment, the sense and antisense sequence flank a loop sequence that comprises a nucleotide sequence corresponding to all or part of the endogenous messenger RNA of the target gene. Thus, it is the loop region that determines the specificity of the RNA interference. See, for example, WO 02/00904, herein incorporated by reference.

v. Amplicon-Mediated Interference

Amplicon expression cassettes comprise a plant virus-derived sequence that contains all or part of the target gene but generally not all of the genes of the native virus. The viral sequences present in the transcription product of the expression cassette allow the transcription product to direct its own replication. The transcripts produced by the amplicon may be either sense or antisense relative to the target sequence (i.e., the messenger RNA for the SCW polypeptide). Methods of using amplicons to inhibit the expression of endogenous plant genes are described, for example, in Angell and Baulcombe (1997) *EMBO J.* 16:3675-3684, Angell and Baulcombe (1999) *Plant J.* 20:357-362, and U.S. Pat. No. 6,646,805, each of which is herein incorporated by reference.

vi. Ribozymes

In some embodiments, the polynucleotide expressed by the expression cassette of the invention is catalytic RNA or has ribozyme activity specific for the messenger RNA of the SCW polypeptide. Thus, the polynucleotide causes the degradation of the endogenous messenger RNA, resulting in reduced expression of the SCW polypeptide. This method is described, for example, in U.S. Pat. No. 4,987,071, herein incorporated by reference.

vii. Small Interfering RNA or Micro RNA

In some embodiments of the invention, inhibition of the expression of a SCW polypeptide may be obtained by RNA interference by expression of a gene encoding a micro RNA (miRNA). miRNAs are regulatory agents consisting of about 22 ribonucleotides. miRNA are highly efficient at inhibiting the expression of endogenous genes. See, for example, Javier, et al., (2003) *Nature* 425:257-263, herein incorporated by reference.

For miRNA interference, the expression cassette is designed to express an RNA molecule that is modeled on an endogenous miRNA gene. The miRNA gene encodes an RNA that forms a hairpin structure containing a 22-nucleotide sequence that is complementary to another endogenous gene (target sequence). For suppression of SCW expression, the 22-nucleotide sequence is selected from a SCW transcript sequence and contains 22 nucleotides of said SCW sequence in sense orientation and 21 nucleotides of a corresponding antisense sequence that is complementary to the sense sequence. miRNA molecules are highly efficient at inhibiting the expression of endogenous genes, and the RNA interference they induce is inherited by subsequent generations of plants.

2. Polypeptide-Based Inhibition of Gene Expression

In one embodiment, the polynucleotide encodes a zinc finger protein that binds to a gene encoding an SCW polypeptide, resulting in reduced expression of the gene. In particular embodiments, the zinc finger protein binds to a regulatory region of an SCW gene. In other embodiments, the zinc finger protein binds to a messenger RNA encoding an SCW polypeptide and prevents its translation. Methods of selecting sites for targeting by zinc finger proteins have been described, for example, in U.S. Pat. No. 6,453,242, and methods for using zinc finger proteins to inhibit the expression of genes in plants are described, for example, in US Patent Application Publication Number 20030037355; each of which is herein incorporated by reference.

3. Polypeptide-Based Inhibition of Protein Activity

In some embodiments of the invention, the polynucleotide encodes an antibody that binds to at least one SCW polypeptide, and reduces the secondary cell wall formation activity of the SCW polypeptide. In another embodiment, the binding of the antibody results in increased turnover of the antibody-SCW complex by cellular quality control mechanisms. The expression of antibodies in plant cells and the inhibition of molecular pathways by expression and binding of antibodies to proteins in plant cells are well known in the art. See, for example, Conrad and Sonnewald (2003) *Nature Biotech.* 21:35-36, incorporated herein by reference.

4. Gene Disruption

In some embodiments of the present invention, the activity of an SCW polypeptide is reduced or eliminated by disrupting the gene encoding the SCW polypeptide. The gene encoding the SCW polypeptide may be disrupted by any method known in the art. For example, in one embodiment, the gene is disrupted by transposon tagging. In another embodiment, the gene is disrupted by mutagenizing plants using random or targeted mutagenesis, and selecting for plants that have reduced secondary cell wall development activity.

i. Transposon Tagging

In one embodiment of the invention, transposon tagging is used to reduce or eliminate the SCW activity of one or more SCW polypeptide. Transposon tagging comprises inserting a transposon within an endogenous SCW gene to reduce or eliminate expression of the SCW polypeptide. "SCW gene" is intended to mean the gene that encodes an SCW polypeptide according to the invention.

In this embodiment, the expression of one or more SCW polypeptide is reduced or eliminated by inserting a transposon within a regulatory region or coding region of the gene encoding the SCW polypeptide. A transposon that is within an exon, intron, 5' or 3' untranslated sequence, a promoter, or any other regulatory sequence of a SCW gene may be used to reduce or eliminate the expression and/or activity of the encoded SCW polypeptide.

Methods for the transposon tagging of specific genes in plants are well known in the art. See, for example, Maes, et al., (1999) *Trends Plant Sci.* 4:90-96; Dharmapuri and Sonti (1999) *FEMS Microbiol. Lett.* 179:53-59; Meissner, et al., (2000) *Plant J.* 22:265-274; Phogat, et al., (2000) *J. Biosci.* 25:57-63; Walbot (2000) *Curr. Opin. Plant Biol.* 2:103-107; Gai, et al., (2000) *Nucleic Acids Res.* 28:94-96; Fitzmaurice, et al., (1999) *Genetics* 153:1919-1928). In addition, the TUSC process for selecting Mu insertions in selected genes has been described in Bensen, et al., (1995) *Plant Cell* 7:75-84; Mena, et al., (1996) *Science* 274:1537-1540; and U.S. Pat. No. 5,962,764; each of which is herein incorporated by reference.

ii. Mutant Plants with Reduced Activity

Additional methods for decreasing or eliminating the expression of endogenous genes in plants are also known in the art and can be similarly applied to the instant invention. These methods include other forms of mutagenesis, such as ethyl methanesulfonate-induced mutagenesis, deletion mutagenesis, and fast neutron deletion mutagenesis used in a reverse genetics sense (with PCR) to identify plant lines in which the endogenous gene has been deleted. For examples of these methods see, Ohshima, et al., (1998) *Virology* 243: 472-481; Okubara, et al., (1994) *Genetics* 137:867-874; and Quesada, et al., (2000) *Genetics* 154:421-436; each of which is herein incorporated by reference. In addition, a fast and automatable method for screening for chemically induced mutations, TILLING (Targeting Induced Local Lesions In Genomes), using denaturing HPLC or selective endonuclease digestion of selected PCR products is also applicable to the instant invention. See, McCallum, et al., (2000) *Nat. Biotechnol.* 18:455-457, herein incorporated by reference.

Mutations that impact gene expression or that interfere with the function (secondary cell wall formation activity) of the encoded protein are well known in the art. Insertional mutations in gene exons usually result in null-mutants. Mutations in conserved residues are particularly effective in inhibiting the secondary cell wall formation activity of the encoded protein. Conserved residues of plant SCW polypeptides suitable for mutagenesis with the goal to eliminate secondary cell wall development activity have been described. Such mutants can be isolated according to well-known procedures, and mutations in different SCW loci can be stacked by genetic crossing. See, for example, Gruis, et al., (2002) *Plant Cell* 14:2863-2882.

In another embodiment of this invention, dominant mutants can be used to trigger RNA silencing due to gene inversion and recombination of a duplicated gene locus. See, for example, Kusaba, et al., (2003) *Plant Cell* 15:1455-1467.

The invention encompasses additional methods for reducing or eliminating the activity of one or more SCW polypeptide. Examples of other methods for altering or mutating a genomic nucleotide sequence in a plant are known in the art and include, but are not limited to, the use of RNA:DNA vectors, RNA:DNA mutational vectors, RNA:DNA repair vectors, mixed-duplex oligonucleotides, self-complementary RNA:DNA oligonucleotides, and recombinogenic oligonucleobases. Such vectors and methods of use are known in the art. See, for example, U.S. Pat. Nos. 5,565,350; 5,731,181; 5,756,325; 5,760,012; 5,795,972; and 5,871,984; each of which are herein incorporated by reference. See also, WO 98/49350, WO 99/07865, WO 99/25821, and Beetham, et al., (1999) *Proc. Natl. Acad. Sci. USA* 96:8774-8778; each of which is herein incorporated by reference.

iii. Modulating Plant Growth and/or Secondary Cell Wall Development Activity

In specific methods, the level and/or activity of a secondary cell wall development gene in a plant is increased by increasing the level or activity of the SCW polypeptide in the plant. Methods for increasing the level and/or activity of SCW polypeptides in a plant are discussed elsewhere herein. Briefly, such methods comprise providing a SCW polypeptide of the invention to a plant and thereby increasing the level and/or activity of the SCW polypeptide. In other embodiments, an SCW nucleotide sequence encoding an SCW polypeptide can be provided by introducing into the plant a polynucleotide comprising an SCW nucleotide sequence of the invention, expressing the SCW sequence, increasing the activity of the SCW polypeptide, and thereby increasing the secondary cell wall formation in the plant or plant part. In other embodiments, the SCW nucleotide construct introduced into the plant is stably incorporated into the genome of the plant.

In other methods, the number of cells and biomass of a plant tissue is increased by increasing the level and/or activity of the SCW polypeptide in the plant. Such methods are disclosed in detail elsewhere herein. In one such method, an SCW nucleotide sequence is introduced into the plant and expression of said SCW nucleotide sequence decreases the activity of the SCW polypeptide, and thereby increasing the plant growth and/or secondary cell wall development in the plant or plant part. In other embodiments, the SCW nucleotide construct introduced into the plant is stably incorporated into the genome of the plant.

As discussed above, one of skill will recognize the appropriate promoter to use to modulate the level/activity of a plant growth and/or secondary cell wall development polynucleotide and polypeptide in the plant. Exemplary promoters for this embodiment have been disclosed elsewhere herein.

Accordingly, the present invention further provides plants having a modified plant growth and/or secondary cell wall development when compared to the plant growth and/or secondary cell wall development of a control plant tissue. In one embodiment, the plant of the invention has an increased level/activity of the SCW polypeptide of the invention and thus has increased plant growth and/or secondary cell wall development in the plant tissue. In other embodiments, the plant of the invention has a reduced or eliminated level of the SCW polypeptide of the invention and thus has decreased plant growth and/or secondary cell wall development in the plant tissue. In other embodiments, such plants have stably incorporated into their genome a nucleic acid molecule comprising a SCW nucleotide sequence of the invention operably linked to a promoter that drives expression in the plant cell.

iv. Modulating Root Development

Methods for modulating root development in a plant are provided. By "modulating root development" is intended any alteration in the development of the plant root when compared to a control plant. Such alterations in root development include, but are not limited to, alterations in the growth rate of the primary root, the fresh root weight, the extent of lateral and adventitious root formation, the vasculature system, meristem development, or radial expansion. In particular, the most desirable outcome would be a root with a stronger vasculature that improves the standability of the plant and thus reduces root lodging as well as being less susceptible to pests.

Methods for modulating root development in a plant are provided. The methods comprise modulating the level and/or activity of the SCW polypeptide in the plant. In one method, an SCW sequence of the invention is provided to the plant. In another method, the SCW nucleotide sequence is provided by introducing into the plant a polynucleotide comprising an SCW nucleotide sequence of the invention, expressing the SCW sequence, and thereby modifying root development. In still other methods, the SCW nucleotide construct introduced into the plant is stably incorporated into the genome of the plant.

In other methods, root development is modulated by altering the level or activity of the SCW polypeptide in the plant. An increase in SCW activity can result in at least one or more of the following alterations to root development, including, but not limited to, larger root meristems, increased in root growth, enhanced radial expansion, an enhanced vasculature system, increased root branching, more adventitious roots, and/or an increase in fresh root weight when compared to a control plant.

As used herein, "root growth" encompasses all aspects of growth of the different parts that make up the root system at different stages of its development in both monocotyledonous and dicotyledonous plants. It is to be understood that enhanced root growth can result from enhanced growth of one or more of its parts including the primary root, lateral roots, adventitious roots, etc.

Methods of measuring such developmental alterations in the root system are known in the art. See, for example, US Patent Application Number 2003/0074698 and Werner, et al., (2001) *PNAS* 18:10487-10492, both of which are herein incorporated by reference.

As discussed above, one of skill will recognize the appropriate promoter to use to modulate root development in the plant. Exemplary promoters for this embodiment include constitutive promoters and root-preferred promoters. Exemplary root-preferred promoters have been disclosed elsewhere herein.

Stimulating root growth and increasing root mass by increasing the activity and/or level of the SCW polypeptide also finds use in improving the standability of a plant. The term "resistance to lodging" or "standability" refers to the ability of a plant to fix itself to the soil. For plants with an erect or semi-erect growth habit, this term also refers to the ability to maintain an upright position under adverse (environmental) conditions. This trait relates to the size, depth and morphology of the root system. In addition, stimulating root growth and increasing root mass by increasing the level and/or activity of the SCW polypeptide also finds use in promoting in vitro propagation of explants.

Furthermore, higher root biomass production due to an increased level and/or activity of SCW activity has a direct effect on the yield and an indirect effect of production of compounds produced by root cells or transgenic root cells or cell cultures of said transgenic root cells. One example of an interesting compound produced in root cultures is shikonin, the yield of which can be advantageously enhanced by said methods.

Accordingly, the present invention further provides plants having modulated root development when compared to the root development of a control plant. In some embodiments, the plant of the invention has an increased level/activity of the SCW polypeptide of the invention and has enhanced root growth and/or root biomass. In other embodiments, such plants have stably incorporated into their genome a nucleic acid molecule comprising a SCW nucleotide sequence of the invention operably linked to a promoter that drives expression in the plant cell.

v. Modulating Shoot and Leaf Development

Methods are also provided for modulating shoot and leaf development in a plant. By "modulating shoot and/or leaf development" is intended any alteration in the development of the plant shoot and/or leaf. Such alterations in shoot and/or leaf development include, but are not limited to, alterations in shoot meristem development, in leaf number, leaf size, leaf and stem vasculature, internode length, and leaf senescence. As used herein, "leaf development" and "shoot development" encompasses all aspects of growth of the different parts that make up the leaf system and the shoot system, respectively, at different stages of their development, both in monocotyledonous and dicotyledonous plants. Methods for measuring such developmental alterations in the shoot and leaf system are known in the art. See, for example, Werner, et al., (2001) PNAS 98:10487-10492 and US Patent Application Number 2003/0074698, each of which is herein incorporated by reference.

The method for modulating shoot and/or leaf development in a plant comprises modulating the activity and/or level of an SCW polypeptide of the invention. In one embodiment, an SCW sequence of the invention is provided. In other embodiments, the SCW nucleotide sequence can be provided by introducing into the plant a polynucleotide comprising an SCW nucleotide sequence of the invention, expressing the SCW sequence, and thereby modifying shoot and/or leaf development. In other embodiments, the SCW nucleotide construct introduced into the plant is stably incorporated into the genome of the plant.

In specific embodiments, shoot or leaf development is modulated by decreasing the level and/or activity of the SCW polypeptide in the plant. An decrease in SCW activity can result in at least one or more of the following alterations in shoot and/or leaf development, including, but not limited to, reduced leaf number, reduced leaf surface, reduced vascular, shorter internodes and stunted growth, and retarded leaf senescence, when compared to a control plant.

As discussed above, one of skill will recognize the appropriate promoter to use to modulate shoot and leaf development of the plant. Exemplary promoters for this embodiment include constitutive promoters, shoot-preferred promoters, shoot meristem-preferred promoters, and leaf-preferred promoters. Exemplary promoters have been disclosed elsewhere herein.

Decreasing SCW activity and/or level in a plant results in shorter internodes and stunted growth. Thus, the methods of the invention find use in producing dwarf plants. In addition, as discussed above, modulation of SCW activity in the plant modulates both root and shoot growth. Thus, the present invention further provides methods for altering the root/shoot ratio. Shoot or leaf development can further be modulated by decreasing the level and/or activity of the SCW polypeptide in the plant.

Accordingly, the present invention further provides plants having modulated shoot and/or leaf development when compared to a control plant. In some embodiments, the plant of the invention has an increased level/activity of the SCW polypeptide of the invention, altering the shoot and/or leaf development. Such alterations include, but are not limited to, increased leaf number, increased leaf surface, increased vascularity, longer internodes and increased plant stature, as well as alterations in leaf senescence, as compared to a control plant. In other embodiments, the plant of the invention has a decreased level/activity of the SCW polypeptide of the invention.

vi. Modulating Reproductive Tissue Development

Methods for modulating reproductive tissue development are provided. In one embodiment, methods are provided to modulate floral development in a plant. By "modulating floral development" is intended any alteration in a structure of a plant's reproductive tissue as compared to a control plant in which the activity or level of the SCW polypeptide has not been modulated. "Modulating floral development" further includes any alteration in the timing of the development of a plant's reproductive tissue (i.e., a delayed or an accelerated timing of floral development) when compared to a control plant in which the activity or level of the SCW polypeptide has not been modulated. Macroscopic alterations may include changes in size, shape, number, or location of reproductive tissues, the developmental time period that these structures form, or the ability to maintain or proceed through the flowering process in times of environmental stress. Microscopic alterations may include changes to the types or shapes of cells that make up the reproductive tissues.

The method for modulating floral development in a plant comprises modulating SCW activity in a plant. In one method, an SCW sequence of the invention is provided. An SCW nucleotide sequence can be provided by introducing into the plant a polynucleotide comprising an SCW nucleotide sequence of the invention, expressing the SCW sequence, and thereby modifying floral development. In other embodiments, the SCW nucleotide construct introduced into the plant is stably incorporated into the genome of the plant.

In specific methods, floral development is modulated by decreasing the level or activity of the SCW polypeptide in the plant. A decrease in SCW activity can result in at least one or more of the following alterations in floral development, including, but not limited to, retarded flowering, reduced number of flowers, partial male sterility, and reduced seed set, when compared to a control plant. Inducing delayed flowering or inhibiting flowering can be used to enhance yield in forage crops such as alfalfa. Methods for measuring such developmental alterations in floral development are known in the art. See, for example, Mouradov, et al., (2002) *The Plant Cell* S111-S130, herein incorporated by reference.

As discussed above, one of skill will recognize the appropriate promoter to use to modulate floral development of the plant. Exemplary promoters for this embodiment include constitutive promoters, inducible promoters, shoot-preferred promoters, and inflorescence-preferred promoters.

In other methods, floral development is modulated by increasing the level and/or activity of the SCW sequence of the invention. Such methods can comprise introducing an SCW nucleotide sequence into the plant and increasing the activity of the SCW polypeptide. In other methods, the SCW nucleotide construct introduced into the plant is stably incorporated into the genome of the plant. Increasing expression of the SCW sequence of the invention can modulate floral development during periods of stress. Such methods are described elsewhere herein. Accordingly, the present invention further provides plants having modulated floral development when compared to the floral development of a control plant. Compositions include plants having an increased level/activity of the SCW polypeptide of the invention and having an altered floral development. Compositions also include plants having an increased level/activity of the SCW polypeptide of the invention wherein the plant maintains or proceeds through the flowering process in times of stress.

Methods are also provided for the use of the SCW sequences of the invention to increase seed size and/or weight. The method comprises increasing the activity of the SCW sequences in a plant or plant part, such as the seed. An increase in seed size and/or weight comprises an increased size or weight of the seed and/or an increase in the size or weight of one or more seed part including, for example, the embryo, endosperm, seed coat, aleurone, or cotyledon.

As discussed above, one of skill will recognize the appropriate promoter to use to increase seed size and/or seed weight. Exemplary promoters of this embodiment include constitutive promoters, inducible promoters, seed-preferred promoters, embryo-preferred promoters, and endosperm-preferred promoters.

The method for decreasing seed size and/or seed weight in a plant comprises decreasing SCW activity in the plant. In one embodiment, the SCW nucleotide sequence can be provided by introducing into the plant a polynucleotide comprising a SCW nucleotide sequence of the invention, expressing the SCW sequence, and thereby increasing seed weight and/or size. In other embodiments, the SCW nucleotide construct introduced into the plant is stably incorporated into the genome of the plant.

It is further recognized that increasing seed size and/or weight can also be accompanied by an increase in the speed of growth of seedlings or an increase in early vigor. As used herein, the term "early vigor" refers to the ability of a plant to grow rapidly during early development, and relates to the successful establishment, after germination, of a well-developed root system and a well-developed photosynthetic apparatus. In addition, an increase in seed size and/or weight can also result in an increase in plant yield when compared to a control.

Accordingly, the present invention further provides plants having an increased seed weight and/or seed size when compared to a control plant. In other embodiments, plants having an increased vigor and plant yield are also provided. In some embodiments, the plant of the invention has an increased level/activity of the SCW polypeptide of the invention and has an increased seed weight and/or seed size. In other embodiments, such plants have stably incorporated into their genome a nucleic acid molecule comprising a SCW nucleotide sequence of the invention operably linked to a promoter that drives expression in the plant cell.

vii. Method of Use for SCW Promoter Polynucleotides

The polynucleotides comprising the SCW promoters disclosed in the present invention, as well as variants and fragments thereof, are useful in the genetic manipulation of any host cell, preferably plant cell, when assembled with a DNA construct such that the promoter sequence is operably linked to a nucleotide sequence comprising a polynucleotide of interest. In this manner, the SCW promoter polynucleotides of the invention are provided in expression cassettes along with a polynucleotide sequence of interest for expression in the host cell of interest. The SCW promoter sequences of the invention are expressed in a variety of tissues containing cells that have secondary walls and thus the promoter sequences can find use in regulating the temporal and/or the spatial expression of polynucleotides of interest particularly in the secondary wall-containing cells.

Synthetic hybrid promoter regions are known in the art. Such regions comprise upstream promoter elements of one polynucleotide operably linked to the promoter element of another polynucleotide. In an embodiment of the invention, heterologous sequence expression is controlled by a synthetic hybrid promoter comprising the SCW promoter sequences of the invention, or a variant or fragment thereof, operably linked to upstream promoter element(s) from a heterologous promoter. Upstream promoter elements that are involved in the plant defense system have been identified and may be used to generate a synthetic promoter. See, for example, Rushton, et al., (1998) Curr. Opin. Plant Biol. 1:311-315. Alternatively, a synthetic SCW promoter sequence may comprise duplications of the upstream promoter elements found within the SCW promoter sequences.

It is recognized that the promoter sequence of the invention may be used with its native SCW coding sequences. A DNA construct comprising the SCW promoter operably linked with its native SCW gene may be used to transform any plant of interest to bring about a desired phenotypic change, such as modulating cell number, modulating root, shoot, leaf, floral, and embryo development, stress tolerance, and any other phenotype described elsewhere herein.

The promoter nucleotide sequences and methods disclosed herein are useful in regulating expression of any heterologous nucleotide sequence in a host plant in order to vary the phenotype of a plant. Various changes in phenotype are of interest including modifying the fatty acid composition in a plant, altering the amino acid content of a plant, altering a plant's pathogen defense mechanism, and the like. These results can be achieved by providing expression of heterologous products or increased expression of endogenous products in plants. Alternatively, the results can be achieved by providing for a reduction of expression of one or more endogenous products, particularly enzymes or cofactors in the plant. These changes result in a change in phenotype of the transformed plant.

Genes of interest are reflective of the commercial markets and interests of those involved in the development of the crop. Crops and markets of interest change, and as developing nations open up world markets, new crops and technologies will emerge also. In addition, as our understanding of agronomic traits and characteristics such as yield and heterosis increase, the choice of genes for transformation will change accordingly. General categories of genes of interest include, for example, those genes involved in information, such as zinc fingers, those involved in communication, such as kinases, and those involved in housekeeping, such as heat shock proteins. More specific categories of transgenes, for example, include genes encoding important traits for agronomics, insect resistance, disease resistance, herbicide resistance, sterility, grain characteristics, and commercial products. Genes of interest include, generally, those involved in oil, starch, carbohydrate, or nutrient metabolism as well as those affecting kernel size, sucrose loading, and the like.

In certain embodiments the nucleic acid sequences of the present invention can be used in combination ("stacked") with other polynucleotide sequences of interest in order to create plants with a desired phenotype. The combinations generated can include multiple copies of any one or more of the polynucleotides of interest. The polynucleotides of the present invention may be stacked with any gene or combination of genes to produce plants with a variety of desired trait combinations, including but not limited to traits desirable for animal feed such as high oil genes (e.g., U.S. Pat. No. 6,232,529); balanced amino acids (e.g., hordothionins (U.S. Pat. Nos. 5,990,389; 5,885,801; 5,885,802; and 5,703,409); barley high lysine (Williamson, et al., (1987) Eur. J. Biochem. 165:99-106; and WO 98/20122); and high methionine proteins (Pedersen, et al., (1986) J. Biol. Chem. 261:6279; Kirihara, et al., (1988) Gene 71:359; and Musumura, et al., (1989) Plant Mol. Biol. 12:123)); increased digestibility (e.g., modified storage proteins (U.S. patent application Ser. No. 10/053,410, filed Nov. 7, 2001); and thioredoxins (U.S. patent application Ser. No. 10/005,429, filed Dec. 3, 2001)), the disclosures of which are herein incorporated by reference. The polynucleotides of the present invention can also be stacked with traits desirable for insect, disease or herbicide resistance (e.g., Bacillus thuringiensis toxic proteins (U.S. Pat. Nos. 5,366,892; 5,747,450; 5,737,514; 5,723,756; 5,593,881; Geiser, et al., (1986) Gene 48:109); lectins (Van Damme, et al., (1994) Plant Mol. Biol. 24:825); fumonisin detoxification genes (U.S. Pat. No. 5,792,931); avirulence and disease resistance genes (Jones, et al., (1994) *Science* 266:789; Martin, et al., (1993) *Science* 262:1432; Mindrinos, et al., (1994) *Cell* 78:1089); acetolactate synthase (ALS) mutants that lead to herbicide resistance such as the S4 and/or Hra mutations; inhibitors of glutamine synthase such as phosphinothricin or basta (e.g., bar gene); and glyphosate resistance (EPSPS gene)); and traits desirable for processing or process products such as high oil (e.g., U.S. Pat. No. 6,232,529); modified oils (e.g., fatty acid desaturase genes (U.S. Pat. No. 5,952,544; WO 94/11516)); modified starches (e.g., ADPG pyrophosphorylases (AGPase), starch synthases (SS), starch branching enzymes (SBE) and starch debranching enzymes (SDBE)); and polymers or bioplastics (e.g., U.S. Pat. No. 5,602,321; beta-ketothiolase, polyhydroxybutyrate synthase, and acetoacetyl-CoA reductase (Schubert, et al., (1988) *J. Bacteriol.* 170:5837-5847) facilitate expression of polyhydroxyalkanoates (PHAs)), the disclosures of which are herein incorporated by reference. One could also combine the polynucleotides of the present invention with polynucleotides affecting agronomic traits such as male sterility (e.g., see, U.S. Pat. No. 5,583,210), stalk strength, flowering time, or transformation technology traits such as cell cycle regulation or gene targeting (e.g., WO 99/61619; WO 00/17364; WO 99/25821), the disclosures of which are herein incorporated by reference.

In one embodiment, sequences of interest improve plant growth and/or crop yields. For example, sequences of interest include agronomically important genes that result in improved primary or lateral root systems. Such genes include, but are not limited to, nutrient/water transporters and growth induces. Examples of such genes, include but are not limited to, maize plasma membrane $H^+$-ATPase (MHA2) (Frias, et al., (1996) *Plant Cell* 8:1533-44); AKT1, a component of the potassium uptake apparatus in *Arabidopsis*, (Spalding, et al., (1999) *J Gen Physiol* 113:909-18); RML genes which activate cell division cycle in the root apical cells (Cheng, et al., (1995) *Plant Physiol* 108:881); maize glutamine synthetase genes (Sukanya, et al., (1994) *Plant Mol Biol* 26:1935-46) and hemoglobin (Duff, et al., (1997) *J. Biol. Chem.* 27:16749-16752, Arredondo-Peter, et al., (1997) *Plant Physiol.* 115:1259-1266; Arredondo-Peter, et al., (1997) *Plant Physiol* 114:493-500 and references sited therein). The sequence of interest may also be useful in expressing antisense nucleotide sequences of genes that that negatively affects root development.

Additional, agronomically important traits such as oil, starch, and protein content can be genetically altered in addition to using traditional breeding methods. Modifications include increasing content of oleic acid, saturated and unsaturated oils, increasing levels of lysine and sulfur, providing essential amino acids, and also modification of starch. Hordothionin protein modifications are described in U.S. Pat. Nos. 5,703,049, 5,885,801, 5,885,802, and 5,990,389, herein incorporated by reference. Another example is lysine and/or sulfur rich seed protein encoded by the soybean 2S albumin described in U.S. Pat. No. 5,850,016, and the chymotrypsin inhibitor from barley, described in Williamson, et al., (1987) *Eur. J. Biochem.* 165:99-106, the disclosures of which are herein incorporated by reference.

Derivatives of the coding sequences can be made by site-directed mutagenesis to increase the level of preselected amino acids in the encoded polypeptide. For example, the gene encoding the barley high lysine polypeptide (BHL) is derived from barley chymotrypsin inhibitor, U.S. patent application Ser. No. 08/740,682, filed Nov. 1, 1996, and WO 98/20133, the disclosures of which are herein incorporated by reference. Other proteins include methionine-rich plant proteins such as from sunflower seed (Lilley, et al., (1989) *Proceedings of the World Congress on Vegetable Protein Utilization in Human Foods and Animal Feedstuffs*, ed. Applewhite (American Oil Chemists Society, Champaign, Ill.), pp. 497-502; herein incorporated by reference); corn (Pedersen, et al., (1986) *J. Biol. Chem.* 261:6279; Kirihara, et al., (1988) *Gene* 71:359; both of which are herein incorporated by reference); and rice (Musumura, et al., (1989) *Plant Mol. Biol.* 12:123, herein incorporated by reference). Other agronomically important genes encode latex, Floury 2, growth factors, seed storage factors, and transcription factors.

Insect resistance genes may encode resistance to pests that have great yield drag such as rootworm, cutworm, European Corn Borer, and the like. Such genes include, for example, *Bacillus thuringiensis* toxic protein genes (U.S. Pat. Nos. 5,366,892; 5,747,450; 5,736,514; 5,723,756; 5,593,881; and Geiser, et al., (1986) *Gene* 48:109); and the like.

Genes encoding disease resistance traits include detoxification genes, such as against fumonosin (U.S. Pat. No. 5,792,931); avirulence (avr) and disease resistance (R) genes (Jones, et al., (1994) *Science* 266:789; Martin, et al., (1993) *Science* 262:1432; and Mindrinos, et al., (1994) *Cell* 78:1089); and the like.

Herbicide resistance traits may include genes coding for resistance to herbicides that act to inhibit the action of acetolactate synthase (ALS), in particular the sulfonylurea-type herbicides (e.g., the acetolactate synthase (ALS) gene containing mutations leading to such resistance, in particular the S4 and/or Hra mutations), genes coding for resistance to herbicides that act to inhibit action of glutamine synthase, such as phosphinothricin or basta (e.g., the bar gene), or other such genes known in the art. The bar gene encodes resistance to the herbicide basta, the nptII gene encodes resistance to the antibiotics kanamycin and geneticin, and the ALS-gene mutants encode resistance to the herbicide chlorsulfuron.

Sterility genes can also be encoded in an expression cassette and provide an alternative to physical detasseling. Examples of genes used in such ways include male tissue-preferred genes and genes with male sterility phenotypes such as QM, described in U.S. Pat. No. 5,583,210. Other genes include kinases and those encoding compounds toxic to either male or female gametophytic development.

The quality of grain is reflected in traits such as levels and types of oils, saturated and unsaturated, quality and quantity of essential amino acids, and levels of cellulose. In corn, modified hordothionin proteins are described in U.S. Pat. Nos. 5,703,049, 5,885,801, 5,885,802, and 5,990,389.

Commercial traits can also be encoded on a gene or genes that could increase for example, starch for ethanol production, or provide expression of proteins. Another important commercial use of transformed plants is the production of polymers and bioplastics such as described in U.S. Pat. No. 5,602,321. Genes such as β-Ketothiolase, PHBase (polyhydroxybutyrate synthase), and acetoacetyl-CoA reductase (see, Schubert, et al., (1988) *J. Bacteriol.* 170:5837-5847) facilitate expression of polyhydroxyalkanoates (PHAs).

Exogenous products include plant enzymes and products as well as those from other sources including procaryotes and other eukaryotes. Such products include enzymes, cofactors, hormones, and the like. The level of proteins, particularly modified proteins having improved amino acid distribution to improve the nutrient value of the plant, can be increased. This is achieved by the expression of such proteins having enhanced amino acid content.

This invention can be better understood by reference to the following non-limiting examples. It will be appreciated by

EXAMPLES

Example 1

Isolation of SCW Sequences

Figure 3:
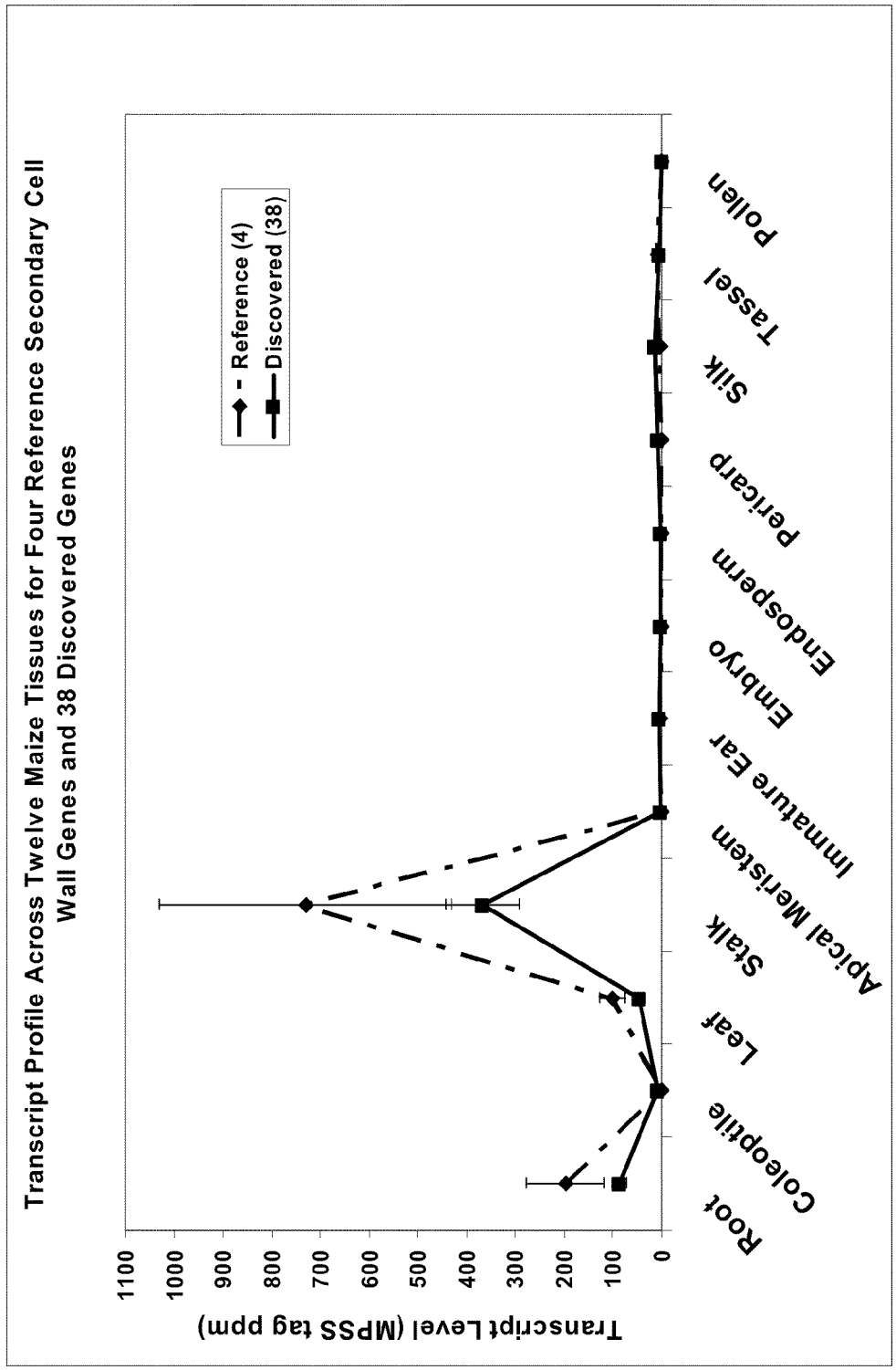
FIG. 3: Transcript profile across twelve maize tissues for 4 reference secondary cell wall genes and 38 discovered genes. Messenger RNA profiles of the four Reference secondary cell wall genes (Bk2, CesA10, CesA11, CesA12) and the 38 discovered genes that have correlated expression patterns. The tissue expression levels represent mean (and SE) values for the MPSS 17-mer tag sets representing the genes in for the reference and discovered sets. The overall gene expression pattern is very similar between the sets, showing peak expression in stalks, slighter expression in roots and leaves, and little expression in other tissues, in particular apical meristem, which lacks secondary cell walls. The mean expression magnitudes are less important than the correspondence of the tissue expression patterns, as transcript and tag levels between genes will vary naturally and for technical reasons.

Of the genes identified thus for to be involved in plant cell wall formation in maize, the cellulose synthase (CesA) genes, CesA10, CesA11 and CesA12 along with another gene, brittle stalk-2 (Bk2), are of particular interest because of their involvement in secondary cell wall formation (Appenzeller, et al., (2004) "Cellulose synthesis in maize: isolation and expression analysis of the cellulose synthase (CesA) gene family"; *Cellulose* 11:287-299; Ching, et al., (2006) "Brittle stalk 2 encodes a putative glycosylphosphatidylinositol-anchored protein that affects mechanical strength of maize tissues by altering the composition and structure of secondary cell walls"; *Planta* 224:1174-1184). As a result, we used these four genes as a reference set with the objective of identifying other genes the expression patterns of which are strongly associated with those of the reference genes. The genes identified with this approach are believed to perform important roles in secondary cell wall formation. FIG. 3 shows a summary of the expression patterns of these four reference genes across 12 key tissue types of maize. Note the characteristic expressions in stalk tissue, which is a key site of secondary cell wall formation in maize.

Example 2

Identification of Genes with Strongly Correlated Expression to Reference Genes Curation of these genes relied on the similarity of their expression patterns to those from the reference set across a large number libraries in the MPSS™ data set. Pioneer-DuPont has an extensive, proprietary collection of 227 maize tissue/treatment MPSS™ samples that cover a wide range of plant structure and biology. The MPSS samples' data is arrayed in a large table against with correlation analyses can be performed. Pearson's correlation coefficients were calculated across 227 samples for pairs in a way that each pair consisted of one member from the reference and the second member from the remaining tags. In doing so a list of four R and $R^2$ values for each subject tag hit was generated, one to each of the four reference genes (specifically to the tag for those genes). These four values were then averaged and ranked in descending order. Those at the top of the list will have the expression pattern across the maize MPSS sample set that is most similar to the four reference genes. For purposes of this study, a minimum cutoff average R value of approximately 0.7 was established. There were additional tags that had correlations below this, but those above this threshold were chosen for continued analysis.

Example 3

Curation of Information about Correlated Genes

The high scoring MPSS tags were mapped to their respective genes or origins using proprietary and public genomic and transcript sequence resources. Some MPSS tags proved to be alternate tags for the reference genes, and were thus excluded. Where there were ambiguous tag-to-gene matches, the gene of interest was revealed by conferring with other expression data, such as from ESTs, wherein expression in stalk tissue especially was considered evidence of the correct gene. The best description of the gene and its gene product, identifying promoters, transcript regions, ORFs, and conceptual translations were thus obtained. This often required manual curations. Then, the map positions of the genes were also determined, primarily using the proprietary PHD v1.2 map. The conceptual translations of the genes were re-analyzed to discern their respective likely functions. The Swiss-Prot database and various computational tools and other resources were used for this purpose.

Example 4

Validation of Gene Discovery Candidates Using Reverse Genetics

The secondary wall forming genes (SCW) datasheet also shows the current prioritizations made for validation by selected knockout mutagenesis (reverse genetics). Reverse genetics resources enable the functional analysis of sequenced gene candidates. Pioneer's TUSC system is a library of insertion mutants created with the maize transposable element family, Mutator, Meeley and Briggs (1995) "Reverse genetics for maize" *Maize Genet. Coop. Newsl.* 69:67-82. This is a patented approach with which to identify transposon insertion mutants for a selected gene sequence (Briggs and Meeley, U.S. Pat. No. 5,962,764).

In order to characterize the candidate genes, a working gene model for each prioritized SCW candidate would be translated into the best available genomic sequence model by making use of available maize genomic data from public and proprietary sequence databases. Gene-specific PCR primers are then designed for each candidate sequence to be submitted through the TUSC screening process. These primers would be validated in pairs on non-mutant genomic DNA, and each primer is then subsequently paired together with a universal Mutator-specific primer in iterative insertion screens against DNA from the TUSC population. Individual insertion alleles identified in this procedure are confirmed for heritability among F2 progeny from selected TUSC lines, and seed from each positive line is retrieved for field propagation. The field materials define segregating maize families in which insertion (null) alleles for SCW genes are genetically segregating. Mutator insertion positions are then be determined by PCR and DNA sequencing. Genetically, each mutant allele would be submitted to several rounds of backcrossing to clean up background mutations, and subsequently selfed to create segregating mutant families and homozygous SCW gene mutant stocks in defined genetic backgrounds. Interallelic crosses can also be attempted whenever possible to help speed the phenotypic analysis of selected mutant loci. Phenotypic analysis of SCW components proceeds by comparing null mutants with their appropriate controls, and the top candidates then are advanced for more detailed studies on the contribution of each candidate gene to SCW formation/deposition. Several tests could be employed, such as internodal mechanical strength, cellulose concentration in the stalk walls, and perhaps scanning electron microscopy, to determine whether the integrity of the secondary wall has been affected (Appenzeller, et al., (2004) "Cellulose synthesis in maize: isolation and expression analysis of the cellulose synthase (CesA) gene family"; *Cellulose* 11:287-299; Ching, et al., (2006) "Brittle stalk 2 encodes a putative glycosylphosphatidylinositol-anchored protein that affects mechanical strength of maize tissues by altering the composition and structure of secondary cell walls"; *Planta* 224:1174-1184).

Example 5

Transformation and Regeneration of Transgenic Plants

Immature maize embryos from greenhouse donor plants are bombarded with a plasmid containing the ZmSCW sequence operably linked to the drought-inducible promoter RAB17 promoter (Vilardell, et al., (1990) *Plant Mol Biol* 14:423-432) and the selectable marker gene PAT, which confers resistance to the herbicide Bialaphos. Alternatively, the selectable marker gene is provided on a separate plasmid. Transformation is performed as follows. Media recipes follow below.

Preparation of Target Tissue:

The ears are husked and surface sterilized in 30% Clorox bleach plus 0.5% Micro detergent for 20 minutes, and rinsed two times with sterile water. The immature embryos are excised and placed embryo axis side down (scutellum side up), 25 embryos per plate, on 560Y medium for 4 hours and then aligned within the 2.5-cm target zone in preparation for bombardment.

Preparation of DNA:

A plasmid vector comprising the SCW sequence operably linked to an ubiquitin promoter is made. This plasmid DNA plus plasmid DNA containing a PAT selectable marker is precipitated onto 1.1 μm (average diameter) tungsten pellets using a $CaCl_2$ precipitation procedure as follows:

100 μl prepared tungsten particles in water
10 μl (1 μg) DNA in Tris EDTA buffer (1 μg total DNA)
100 μl 12.5 M $CaCl_2$
10 μl 0.1 M spermidine Each reagent is added sequentially to the tungsten particle suspension, while maintained on the multitube vortexer. The final mixture is sonicated briefly and allowed to incubate under constant vortexing for 10 minutes. After the precipitation period, the tubes are centrifuged briefly, liquid removed, washed with 500 ml 100% ethanol, and centrifuged for 30 seconds. Again the liquid is removed, and 105 μl 100% ethanol is added to the final tungsten particle pellet. For particle gun bombardment, the tungsten/DNA particles are briefly sonicated and 10 μl spotted onto the center of each macrocarrier and allowed to dry about 2 minutes before bombardment.

Particle Gun Treatment:

The sample plates are bombarded at level #4 in particle gun #HE34-1 or #HE34-2. All samples receive a single shot at 650 PSI, with a total of ten aliquots taken from each tube of prepared particles/DNA.

Subsequent Treatment:

Following bombardment, the embryos are kept on 560Y medium for 2 days, then transferred to 560R selection medium containing 3 mg/liter Bialaphos, and subcultured every 2 weeks. After approximately 10 weeks of selection, selection-resistant callus clones are transferred to 288J medium to initiate plant regeneration. Following somatic embryo maturation (2-4 weeks), well-developed somatic embryos are transferred to medium for germination and transferred to the lighted culture room. Approximately 7-10 days later, developing plantlets are transferred to 272V hormone-free medium in tubes for 7-10 days until plantlets are well established. Plants are then transferred to inserts in flats (equivalent to 2.5" pot) containing potting soil and grown for 1 week in a growth chamber, subsequently grown an additional 1-2 weeks in the greenhouse, then transferred to classic 600 pots (1.6 gallon) and grown to maturity. Plants are monitored and scored for increased drought tolerance. Assays to measure improved drought tolerance are routine in the art and include, for example, increased kernel-earring capacity yields under drought conditions when compared to control maize plants under identical environmental conditions. Alternatively, the transformed plants can be monitored for a modulation in meristem development (i.e., a decrease in spikelet formation on the ear). See, for example, Bruce, et al., (2002) *Journal of Experimental Botany* 53:1-13.

Bombardment and Culture Media:

Bombardment medium (560Y) comprises 4.0 g/l N6 basal salts (SIGMA C-1416), 1.0 ml/l Eriksson's Vitamin Mix (1000×SIGMA-1511), 0.5 mg/l thiamine HCl, 120.0 g/l sucrose, 1.0 mg/l 2,4-D, and 2.88 g/l L-proline (brought to volume with D-I $H_2O$ following adjustment to pH 5.8 with KOH); 2.0 g/l Gelrite (added after bringing to volume with D-I $H_2O$); and 8.5 mg/l silver nitrate (added after sterilizing the medium and cooling to room temperature). Selection medium (560R) comprises 4.0 g/l N6 basal salts (SIGMA C-1416), 1.0 ml/l Eriksson's Vitamin Mix (1000×SIGMA-1511), 0.5 mg/l thiamine HCl, 30.0 g/l sucrose, and 2.0 mg/l 2,4-D (brought to volume with D-I $H_2O$ following adjustment to pH 5.8 with KOH); 3.0 g/l Gelrite (added after bringing to volume with D-I $H_2O$); and 0.85 mg/l silver nitrate and 3.0 mg/l bialaphos (both added after sterilizing the medium and cooling to room temperature).

Plant regeneration medium (288J) comprises 4.3 g/l MS salts (GIBCO 11117-074), 5.0 ml/l MS vitamins stock solution (0.100 g nicotinic acid, 0.02 g/l thiamine HCL, 0.10 g/l pyridoxine HCL, and 0.40 g/l glycine brought to volume with polished D-I $H_2O$) (Murashige and Skoog (1962) *Physiol. Plant.* 15:473), 100 mg/l myo-inositol, 0.5 mg/l zeatin, 60 g/l sucrose, and 1.0 ml/l of 0.1 mM abscisic acid (brought to volume with polished D-I $H_2O$ after adjusting to pH 5.6); 3.0 g/l Gelrite (added after bringing to volume with D-I $H_2O$); and 1.0 mg/l indoleacetic acid and 3.0 mg/l bialaphos (added after sterilizing the medium and cooling to 60° C.). Hormone-free medium (272V) comprises 4.3 g/l MS salts (GIBCO 11117-074), 5.0 ml/l MS vitamins stock solution (0.100 g/l nicotinic acid, 0.02 g/l thiamine HCL, 0.10 g/l pyridoxine HCL, and 0.40 g/l glycine brought to volume with polished D-I $H_2O$), 0.1 g/l myo-inositol, and 40.0 g/l sucrose (brought to volume with polished D-I $H_2O$ after adjusting pH to 5.6); and 6 g/l bacto-agar (added after bringing to volume with polished D-I $H_2O$), sterilized and cooled to 60° C.

Example 6

*Agrobacterium*-Mediated Transformation

For *Agrobacterium*-mediated transformation of maize with an antisense sequence of the ZmSCW sequence of the present invention, preferably the method of Zhao is employed (U.S. Pat. No. 5,981,840, and PCT Patent Publication WO98/32326; the contents of which are hereby incorporated by reference). Briefly, immature embryos are isolated from maize and the embryos contacted with a suspension of *Agrobacterium*, where the bacteria are capable of transferring the SCW sequence to at least one cell of at least one of the immature embryos (step 1: the infection step). In this step the immature embryos are preferably immersed in an *Agrobacterium* suspension for the initiation of inoculation. The embryos are co-cultured for a time with the *Agrobacterium* (step 2: the co-cultivation step). Preferably the immature embryos are cultured on solid medium following the infection step. Following this co-cultivation period an optional "resting" step is contemplated. In this resting step, the embryos are incubated in the presence of at least one antibiotic known to inhibit the growth of *Agrobacterium* without the addition of a selective agent for plant transformants (step 3: resting step). Preferably the immature embryos are cultured on solid medium with antibiotic, but without a selecting agent, for elimination of *Agrobacterium* and for a resting phase for the infected cells. Next, inoculated embryos are cultured on medium containing a selective agent and growing transformed callus is recovered (step 4: the selection step). Preferably, the immature embryos are cultured on solid medium with a selective agent resulting in the selective growth of transformed cells. The callus is then regenerated into plants (step 5: the regeneration step), and preferably calli grown on selective medium are cultured on solid medium to regenerate the plants. Plants are monitored and scored for a modulation in meristem development. For instance, alterations of size and appearance of the shoot and floral meristems and/or increased yields of leaves, flowers, and/or fruits.

Example 7

Expression Patterns

Table 3 below shows a list of the secondary cell wall forming genes in descending order according to their average Pearson's correlation coefficients to the reference genes for expression pattern across 227 maize MPSS libraries. In addition, there is a summary statement of the likely function of each gene and its role in secondary cell wall formation. Many of the genes are implicated in either carbohydrate or lignin metabolism, the two main sub components of the secondary cell wall. However, the list contains many novels genes as well and genes without a present direct relationship to either carbohydrate or lignin synthesis or modification.

TABLE 3

Secondary Cell Wall Forming Genes - Expression Correlations and Function
Table 3. Secondary Wall Formation Genes - Expression Correlations, Descriptions and Likely Function

| Sequence Name | Expression Correlation (Average Pearson's R Value) | Description and Likely Function |
|---|---|---|
| SCW_CMI_04 | 0.85 | Related to plant specific proteins of unknown function, but sometimes annotated as 'leaf senescence related protein-like' |
| SCW_CMI_06 | 0.83 | Member of a plant specific family of conserved proteins. Importantly, three distinct members of the family occur on short list of SCW associated genes (see CMI_06, CMI_25, and CMI_38). Biochemical function unknown, predicted to have a transmembrane domain. |
| SCW_CMI_50 | 0.75 | Myb transcription factor |
| SCW_CMI_22 | 0.75 | Xyloglucan endotransglycosylase/hydrolase protein 8 precursor (EC 2.4.1.207). First of type apparently associated with secondary cell walls |
| SCW_CMI_28 | 0.73 | Fasciclin-like arabinogalactan protein 8 precursor; glycosylphosphatidylinositol-anchored protein |
| SCW_CMI_51 | 0.78 | Endoglucanase 5 precursor (EC 3.2.1.4) |
| SCW_CMI_48 | 0.77 | Fasciclin-like arabinogalactan protein 8 precursor; glycosylphosphatidylinositol-anchored protein |
| SCW_CMI_54 | 0.79 | Leaf senescence protein-like |
| SCW_CMI_13 | 0.80 | L-ascorbate oxidase precursor (EC 1.10.3.3) or Laccase 4 precursor (EC 1.10.3.2) (Benzenediol:oxygen oxidoreductase). Likely lignin formation related. |
| SCW_CMI_09 | 0.82 | L-ascorbate oxidase precursor (EC 1.10.3.3) or Laccase 4 precursor (EC 1.10.3.2) (Benzenediol:oxygen oxidoreductase). Likely lignin formation related. |
| SCW_CMI_56 | 0.83 | Conserved Plant specific Unknown Protein |
| SCW_CMI_53 | 0.83 | Conserved Plant specific Unknown Protein |
| SCW_CMI_21 | 0.76 | Anthranilate N-hydroxycinnamoyl/benzoyltransferase (EC 2.3.1.144). Likely lignin formation related. |
| SCW_CMI_10 | 0.82 | Putative disease resistance response protein-related/dirigent protein. Likely lignin formation related. |
| SCW_CMI_49 | 0.80 | Putative disease resistance response protein-related/dirigent protein. Likely lignin formation related. |
| SCW_CMI_47 | 0.77 | Laccase or L-ascorbate oxidase |
| SCW_CMI_45 | 0.77 | Conserved Plant specific Unknown Protein |
| SCW_CMI_55 | 0.77 | Novel intregral membrane protein; glucose-6-phosphate/phosphate-tranlocator; solute transporter family |
| SCW_CMI_46 | 0.75 | Putative lipid binding protein |
| SCW_CMI_23 | 0.75 | Naringenin, 2-oxoglutarate 3-dioxygenase; Flavonone-3-hydroxylase. Likely lignin formation related. |
| SCW_CMI_39 | 0.86 | Putative 3-methyladenine-DNA glycosylase (EC 3.2.2.20) |
| SCW_CMI_43 | 0.67 | Novel protein, possibly plant specific, which may bear a ring-H2 zinc finger domain. |
| SCW_CMI_57 | 0.73 | Conserved Plant specific Unknown Protein |
| SCW_CMI_44 | 0.72 | NAC Domain Protein, Arabidopsis related annotated as involved in Secondary Cell Wall Formation |
| SCW_CMI_58 | 0.71 | Unknown. Membrane lipoprotein lipid attachment site-containing protein-like |

TABLE 3-continued

Secondary Cell Wall Forming Genes - Expression Correlations and Function
Table 3. Secondary Wall Formation Genes - Expression Correlations, Descriptions and Likely Function

| Sequence Name | Expression Correlation (Average Pearson's R Value) | Description and Likely Function |
|---|---|---|
| SCW_CMI_26 | 0.74 | Cytochrome P450, or Flavonoid 3'-monooxygenase (see EC 1.14.—.— or EC 1.14.13.—). Likely lignin formation related. |
| SCW_CMI_17 | 0.80 | Novel plant specific presumed membrane attached GPI-Anchored protein |
| SCW_CMI_32 | 0.72 | Myb-related transcription factor. Only transcription factor on list. Candidate for control of battery of secondary cell wall associated genes. |
| SCW_CMI_01 | 0.86 | Possible glucosyltransferase, may be related to Exostosin-1. |
| SCW_CMI_05 | 0.84 | Related to Galactosylgalactosylxylosylprotein 3-beta-glucuronosyltransferase P (EC 2.4.1.135) (Beta-1,3-glucuronyltransferase P) |
| SCW_CMI_40 | 0.71 | Related to plant specific proteins of unknown function, but sometimes annotated as 'auxin induced protein' |
| SCW_CMI_41 | 0.66 | Novel plant specific protein, possibly bearing a possible BAG domain (Bcl-2 associated anthogene). May function as chaperone. |

FIG. 3 shows the expression pattern across twelve key maize tissues of the reference secondary cell wall forming genes along with the new secondary cell wall genes found in this study. Note the marked association with stalk expression, a key site of secondary cell wall formation, but also to a lesser extent roots and leaves, where secondary cell walls also form. Interestingly, in apical meristem, where there is essentially only primary cell walls, expression of these genes is nearly absent.

Example 8

Role of Cellulose in Mechanical Strength

Figure 2:
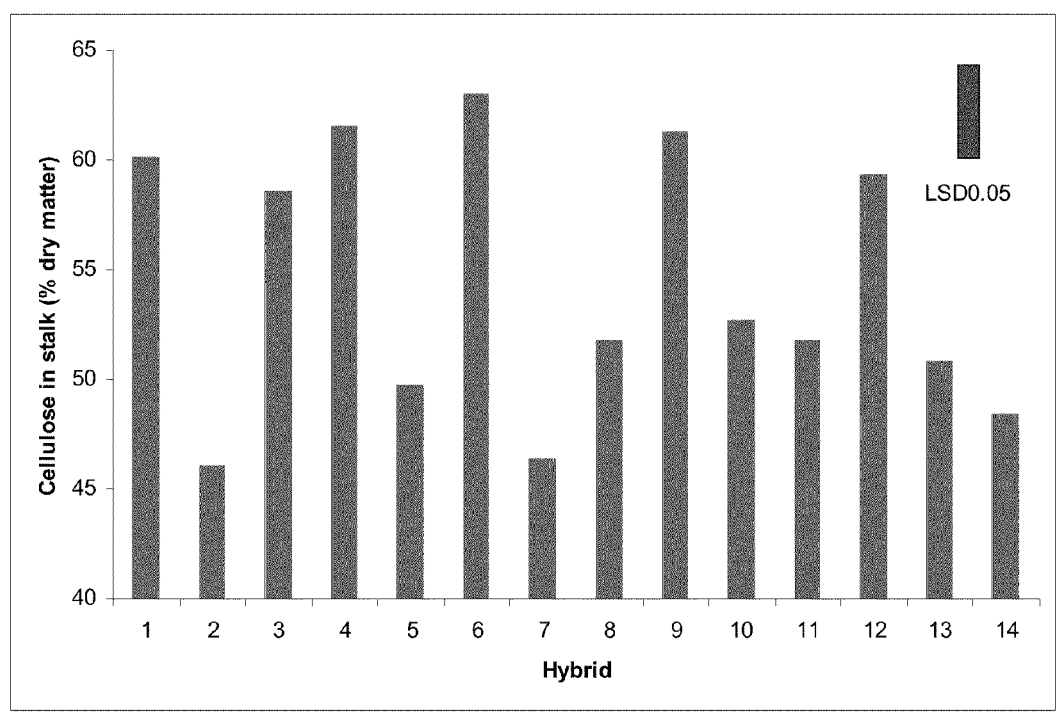
FIG. 2: Cellulose concentration in dry matter of maize hybrids. Data were collected from two plants derived from each of the three field replications. Cellulose was determined by Updegraff method (Updegraff (1969) "Semimicro determination of cellulose in biological materials"; *Anal. Biochem.* 32:120-124) on powdered dry matter obtained from the third internode below the ear at maturity.

Cellulose is the largest single chemical constituent in the vegetative biomass (FIG. 2). It accounts for an average of 50% of the maize stover dry mass. As a largest constituent, any limitation in its deposition can limit growth and thus biomass accumulation. Grain yield in maize is a function of total biomass as the harvest index (ratio of grain to total aboveground biomass) has stayed around 50% for the last century. Any increase in biomass will lead to increased grain yield. The genes that specifically affect cellulose formation will help increase carbohydrate content of the biomass, making it more suitable for silage as well as ethanol production. In addition, a stalk with increased cellulose concentration will have increased mechanical strength, which will make it less likely to lodge and thus indirectly contribute to grain yield increase. The genes for lignin formation and cell wall cross-linking might also help increase the strength of the stalk. Lignin, being hydrophobic, increases the strength of cellulose by excluding water from around the latter. Dry cellulose is known to be stronger than moist cellulose.

Leaves with increased cellulose concentration, because they are mechanically stronger, will be able to maintain a more erect phenotype, which will increase photosynthetic capacity per unit land area by reducing shading.

Example 9

Relative Contribution of Maize Stalk Rind and Inner Tissue to Different Stalk Characteristics and Mechanical Strength The data shown in FIG. 1 was derived from seven hybrids grown at three densities (27, 43 and 59 K per acre) in three replications each in 2001. Two stalks were sampled from each replication. Internodes 3 and 4 below the ear were subjected to a 3-point flexural test with an Instron. After measuring load to cause a break in the internode, the $3^{rd}$ internode was separated into rind and inner tissue. Path coefficient analyses were performed using rind and inner tissue as independent variables ($X_1$ and $X_2$, respectively) and the whole stalk as the dependent variable (Y). The multiple regression equation would look like: $Y=a+b_1X_1+b_2X_2+e$ where a is the intercept, b is regression co-efficient, and e error. Path coefficients were calculated as follows: $pYX_n=b_n*SX_n/sY$ where n is 1 or 2, p is path co-efficient, and s is standard deviation The contribution of each independent variable to whole stalk (Y) was calculated as follows: $s_{YXn}*r_{YXn}$ where sYXn is covariance of Y and Xn, and r is the Pearson correlation coefficient between these two variables. The unexplained variation for diameter is attributable to the corn stalk not being perfectly round and the difficulty thus associated with determining the cross-sectional area accurately. Some other variables, like size and number of vascular bundles and their density, may account for the remaining variation in strength.

Selection for a desirable allele or overexpressing the gene thereof, by removing the limitation of the particular step it encodes the enzyme for catalyzing, may either lead to an increase in the percentage of that particular polysaccharide (composition changed) or of the whole cell wall (composition not changed). In the latter case, the additional dry matter could be accommodated in enlarged vascular bundles which could, in turn, result in an increased diameter Example 10

Soybean Embryo Transformation

Soybean embryos are bombarded with a plasmid containing an SCW sequence operably linked to an ubiquitin promoter as follows. To induce somatic embryos, cotyledons, 3-5 mm in length dissected from surface-sterilized, immature seeds of the soybean cultivar A2872, are cultured in the light or dark at 26° C. on an appropriate agar medium for six to ten weeks. Somatic embryos producing secondary embryos are then excised and placed into a suitable liquid medium. After repeated selection for clusters of somatic embryos that multiplied as early, globular-staged embryos, the suspensions are maintained as described below.

Soybean embryogenic suspension cultures can be maintained in 35 ml liquid media on a rotary shaker, 150 rpm, at 26° C. with florescent lights on a 16:8 hour day/night schedule. Cultures are subcultured every two weeks by inoculating approximately 35 mg of tissue into 35 ml of liquid medium.

Soybean embryogenic suspension cultures may then be transformed by the method of particle gun bombardment (Klein, et al., (1987) *Nature* (London) 327:70-73, U.S. Pat. No. 4,945,050). A Du Pont Biolistic PDS1000/HE instrument (helium retrofit) can be used for these transformations.

A selectable marker gene that can be used to facilitate soybean transformation is a transgene composed of the 35S promoter from Cauliflower Mosaic Virus (Odell, et al., (1985) *Nature* 313:810-812), the hygromycin phosphotransferase gene from plasmid pJR225 (from *E. coli*; Gritz, et al., (1983) *Gene* 25:179-188), and the 3' region of the nopaline synthase gene from the T-DNA of the Ti plasmid of *Agrobacterium tumefaciens*. The expression cassette comprising an SCW sense sequence operably linked to the ubiquitin promoter can be isolated as a restriction fragment. This fragment can then be inserted into a unique restriction site of the vector carrying the marker gene.

To 50 μl of a 60 mg/ml 1 μm gold particle suspension is added (in order): 5 μl DNA (1 μg/μl), 20 μl spermidine (0.1 M), and 50 μl CaCl$_2$ (2.5 M). The particle preparation is then agitated for three minutes, spun in a microfuge for 10 seconds and the supernatant removed. The DNA-coated particles are then washed once in 400 μl 70% ethanol and resuspended in 40 μl of anhydrous ethanol. The DNA/particle suspension can be sonicated three times for one second each. Five microliters of the DNA-coated gold particles are then loaded on each macro carrier disk.

Approximately 300-400 mg of a two-week-old suspension culture is placed in an empty 60×15 mm petri dish and the residual liquid removed from the tissue with a pipette. For each transformation experiment, approximately 5-10 plates of tissue are normally bombarded. Membrane rupture pressure is set at 1100 psi, and the chamber is evacuated to a vacuum of 28 inches mercury. The tissue is placed approximately 3.5 inches away from the retaining screen and bombarded three times. Following bombardment, the tissue can be divided in half and placed back into liquid and cultured as described above.

Five to seven days post bombardment, the liquid media may be exchanged with fresh media, and eleven to twelve days post-bombardment with fresh media containing 50 mg/ml hygromycin. This selective media can be refreshed weekly. Seven to eight weeks post-bombardment, green, transformed tissue may be observed growing from untransformed, necrotic embryogenic clusters. Isolated green tissue is removed and inoculated into individual flasks to generate new, clonally propagated, transformed embryogenic suspension cultures. Each new line may be treated as an independent transformation event. These suspensions can then be subcultured and maintained as clusters of immature embryos or regenerated into whole plants by maturation and germination of individual somatic embryos.

Example 11

Sunflower Meristem Tissue Transformation

Sunflower meristem tissues are transformed with an expression cassette containing an SCW sequence operably linked to a ubiquitin promoter as follows (see also, European Patent Number EP 0 486233, herein incorporated by reference, and Malone-Schoneberg, et al., (1994) *Plant Science* 103:199-207). Mature sunflower seed (*Helianthus annulus* L.) are dehulled using a single wheat-head thresher. Seeds are surface sterilized for 30 minutes in a 20% Clorox bleach solution with the addition of two drops of Tween 20 per 50 ml of solution. The seeds are rinsed twice with sterile distilled water.

Split embryonic axis explants are prepared by a modification of procedures described by Schrammeijer, et al., (Schrammeijer, et al., (1990) *Plant Cell Rep.* 9:55-60). Seeds are imbibed in distilled water for 60 minutes following the surface sterilization procedure. The cotyledons of each seed are then broken off, producing a clean fracture at the plane of the embryonic axis. Following excision of the root tip, the explants are bisected longitudinally between the primordial leaves. The two halves are placed, cut surface up, on GBA medium consisting of Murashige and Skoog mineral elements (Murashige, et al., (1962) *Physiol. Plant.,* 15:473-497), Shepard's vitamin additions (Shepard (1980) in *Emergent Techniques for the Genetic Improvement of Crops* (University of Minnesota Press, St. Paul, Minn.), 40 mg/l adenine sulfate, 30 g/l sucrose, 0.5 mg/l 6-benzyl-aminopurine (BAP), 0.25 mg/l indole-3-acetic acid (IAA), 0.1 mg/l gibberellic acid (GA$_3$), pH 5.6, and 8 g/l Phytagar.

The explants are subjected to microprojectile bombardment prior to *Agrobacterium* treatment (Bidney, et al., (1992) *Plant Mol. Biol.* 18:301-313). Thirty to forty explants are placed in a circle at the center of a 60×20 mm plate for this treatment. Approximately 4.7 mg of 1.8 mm tungsten microprojectiles are resuspended in 25 ml of sterile TE buffer (10 mM Tris HCl, 1 mM EDTA, pH 8.0) and 1.5 ml aliquots are used per bombardment. Each plate is bombarded twice through a 150 mm nytex screen placed 2 cm above the samples in a PDS 1000® particle acceleration device.

Disarmed *Agrobacterium tumefaciens* strain EHA105 is used in all transformation experiments. A binary plasmid vector comprising the expression cassette that contains the SCW gene operably linked to the ubiquitin promoter is introduced into *Agrobacterium* strain EHA105 via freeze-thawing as described by Holsters, et al., (1978) *Mol. Gen. Genet.* 163:181-187. This plasmid further comprises a kanamycin selectable marker gene (i.e, nptII). Bacteria for plant transformation experiments are grown overnight (28° C. and 100 RPM continuous agitation) in liquid YEP medium (10 gm/l yeast extract, 10 gm/l Bactopeptone, and 5 gm/l NaCl, pH 7.0) with the appropriate antibiotics required for bacterial strain and binary plasmid maintenance. The suspension is used when it reaches an OD$_{600}$ of about 0.4 to 0.8. The *Agrobacterium* cells are pelleted and resuspended at a final OD$_{600}$ of 0.5 in an inoculation medium comprised of 12.5 mM MES pH 5.7, 1 gm/l NH$_4$Cl, and 0.3 gm/l MgSO$_4$.

Freshly bombarded explants are placed in an *Agrobacterium* suspension, mixed, and left undisturbed for 30 minutes. The explants are then transferred to GBA medium and co-cultivated, cut surface down, at 26° C. and 18-hour days. After three days of co-cultivation, the explants are transferred to 374B (GBA medium lacking growth regulators and a reduced sucrose level of 1%) supplemented with 250 mg/l cefotaxime and 50 mg/l kanamycin sulfate. The explants are cultured for two to five weeks on selection and then transferred to fresh 374B medium lacking kanamycin for one to two weeks of continued development. Explants with differentiating, antibiotic-resistant areas of growth that have not produced shoots suitable for excision are transferred to GBA medium containing 250 mg/l cefotaxime for a second 3-day phytohormone treatment. Leaf samples from green, kanamycin-resistant shoots are assayed for the presence of NPTII by ELISA and for the presence of transgene expression by assaying for a modulation in meristem development (i.e., an alteration of size and appearance of shoot and floral meristems).

NPTII-positive shoots are grafted to Pioneer® hybrid 6440 in vitro-grown sunflower seedling rootstock. Surface sterilized seeds are germinated in 48-0 medium (half-strength Murashige and Skoog salts, 0.5% sucrose, 0.3% gelrite, pH 5.6) and grown under conditions described for explant culture. The upper portion of the seedling is removed, a 1 cm vertical slice is made in the hypocotyl, and the transformed shoot inserted into the cut. The entire area is wrapped with parafilm to secure the shoot. Grafted plants can be transferred to soil following one week of in vitro culture. Grafts in soil are maintained under high humidity conditions followed by a slow acclimatization to the greenhouse environment. Transformed sectors of $T_0$ plants (parental generation) maturing in the greenhouse are identified by NPTII ELISA and/or by SCW activity analysis of leaf extracts while transgenic seeds harvested from NPTII-positive $T_0$ plants are identified by SCW activity analysis of small portions of dry seed cotyledon.

An alternative sunflower transformation protocol allows the recovery of transgenic progeny without the use of chemical selection pressure. Seeds are dehulled and surface-sterilized for 20 minutes in a 20% Clorox bleach solution with the addition of two to three drops of Tween 20 per 100 ml of solution, then rinsed three times with distilled water. Sterilized seeds are imbibed in the dark at 26° C. for 20 hours on filter paper moistened with water. The cotyledons and root radical are removed, and the meristem explants are cultured on 374E (GBA medium consisting of MS salts, Shepard vitamins, 40 mg/l adenine sulfate, 3% sucrose, 0.5 mg/l 6-BAP, 0.25 mg/l IAA, 0.1 mg/l GA, and 0.8% Phytagar at pH 5.6) for 24 hours under the dark. The primary leaves are removed to expose the apical meristem, around 40 explants are placed with the apical dome facing upward in a 2 cm circle in the center of 374M (GBA medium with 1.2% Phytagar), and then cultured on the medium for 24 hours in the dark.

Approximately 18.8 mg of 1.8 μm tungsten particles are resuspended in 150 μl absolute ethanol. After sonication, 8 μl of it is dropped on the center of the surface of macrocarrier. Each plate is bombarded twice with 650 psi rupture discs in the first shelf at 26 mm of Hg helium gun vacuum.

The plasmid of interest is introduced into *Agrobacterium tumefaciens* strain EHA105 via freeze thawing as described previously. The pellet of overnight-grown bacteria at 28° C. in a liquid YEP medium (10 g/l yeast extract, 10 g/l Bactopeptone, and 5 g/l NaCl, pH 7.0) in the presence of 50 μg/l kanamycin is resuspended in an inoculation medium (12.5 mM 2-mM 2-(N-morpholino) ethanesulfonic acid, MES, 1 g/l NH$_4$Cl and 0.3 g/l MgSO$_4$ at pH 5.7) to reach a final concentration of 4.0 at OD 600. Particle-bombarded explants are transferred to GBA medium (374E), and a droplet of bacteria suspension is placed directly onto the top of the meristem. The explants are co-cultivated on the medium for 4 days, after which the explants are transferred to 374C medium (GBA with 1% sucrose and no BAP, IAA, GA3 and supplemented with 250 μg/ml cefotaxime). The plantlets are cultured on the medium for about two weeks under 16-hour day and 26° C. incubation conditions.

Explants (around 2 cm long) from two weeks of culture in 374C medium are screened for a modulation in meristem development (i.e., an alteration of size and appearance of shoot and floral meristems). After positive (i.e., a change in SCW expression) explants are identified, those shoots that fail to exhibit an alteration in SCW activity are discarded, and every positive explant is subdivided into nodal explants. One nodal explant contains at least one potential node. The nodal segments are cultured on GBA medium for three to four days to promote the formation of auxiliary buds from each node. Then they are transferred to 374C medium and allowed to develop for an additional four weeks. Developing buds are separated and cultured for an additional four weeks on 374C medium. Pooled leaf samples from each newly recovered shoot are screened again by the appropriate protein activity assay. At this time, the positive shoots recovered from a single node will generally have been enriched in the transgenic sector detected in the initial assay prior to nodal culture.

Recovered shoots positive for altered SCW expression are grafted to Pioneer hybrid 6440 in vitro-grown sunflower seedling rootstock. The rootstocks are prepared in the following manner. Seeds are dehulled and surface-sterilized for 20 minutes in a 20% Clorox bleach solution with the addition of two to three drops of Tween 20 per 100 ml of solution, and are rinsed three times with distilled water. The sterilized seeds are germinated on the filter moistened with water for three days, then they are transferred into 48 medium (half-strength MS salt, 0.5% sucrose, 0.3% gelrite pH 5.0) and grown at 26° C. under the dark for three days, then incubated at 16-hour-day culture conditions. The upper portion of selected seedling is removed, a vertical slice is made in each hypocotyl, and a transformed shoot is inserted into a V-cut. The cut area is wrapped with parafilm. After one week of culture on the medium, grafted plants are transferred to soil. In the first two weeks, they are maintained under high humidity conditions to acclimatize to a greenhouse environment.

Example 12

Variants of SCW Sequences

A. Variant Nucleotide Sequences of SCW That Do Not Alter the Encoded Amino Acid Sequence The SCW nucleotide sequences are used to generate variant nucleotide sequences having the nucleotide sequence of the open reading frame with about 70%, 75%, 80%, 85%, 90% and 95% nucleotide sequence identity when compared to the starting unaltered ORF nucleotide sequence of the corresponding SEQ ID NO. These functional variants are generated using a standard codon table. While the nucleotide sequence of the variants are altered, the amino acid sequence encoded by the open reading frames do not change. These variants are associated with component traits that determine biomass production and quality. The ones that show association are then used as markers to select for each component traits.

B. Variant Nucleotide Sequences of SCW in the Non-Coding Regions

The SCW nucleotide sequences are used to generate variant nucleotide sequences having the nucleotide sequence of the 5'-untranslated region, 3'-untranslated region, or promoter region that is approximately 70%, 75%, 80%, 85%, 90% and 95% identical to the original nucleotide sequence of the corresponding SEQ ID NO. These variants are then associated with natural variation in the germplasm for component traits related to biomass production and quality. The associated variants are used as marker haplotypes to select for the desirable traits.

C. Variant Amino Acid Sequences of SCW Polypeptides

Variant amino acid sequences of the SCW polypeptides are generated. In this example, one amino acid is altered. Specifically, the open reading frames are reviewed to determine the appropriate amino acid alteration. The selection of the amino acid to change is made by consulting the protein alignment (with the other orthologs and other gene family members from various species). An amino acid is selected that is deemed not to be under high selection pressure (not highly conserved) and which is rather easily substituted by an amino acid with similar chemical characteristics (i.e., similar functional side-chain). Using a protein alignment, an appropriate amino acid can be changed. Once the targeted amino acid is identified, the procedure outlined in the following section C is followed. Variants having about 70%, 75%, 80%, 85%, 90% and 95% nucleic acid sequence identity are generated using this method. These variants are then associated with natural variation in the germplasm for component traits related to biomass production and quality. The associated variants are used as marker haplotypes to select for the desirable traits.

D. Additional Variant Amino Acid Sequences of SCW Polypeptides

In this example, artificial protein sequences are created having 80%, 85%, 90% and 95% identity relative to the reference protein sequence. This latter effort requires identifying conserved and variable regions from an alignment and then the judicious application of an amino acid substitutions table. These parts will be discussed in more detail below.

Largely, the determination of which amino acid sequences are altered is made based on the conserved regions among SCW protein or among the other SCW polypeptides. Based on the sequence alignment, the various regions of the SCW polypeptide that can likely be altered are represented in lower case letters, while the conserved regions are represented by capital letters. It is recognized that conservative substitutions can be made in the conserved regions below without altering function. In addition, one of skill will understand that functional variants of the SCW sequence of the invention can have minor non-conserved amino acid alterations in the conserved domain.

Artificial protein sequences are then created that are different from the original in the intervals of 80-85%, 85-90%, 90-95% and 95-100% identity. Midpoints of these intervals are targeted, with liberal latitude of plus or minus 1%, for example. The amino acids substitutions will be effected by a custom Perl script. The substitution table is provided below in Table 4.

TABLE 4

| Substitution Table | | | |
|---|---|---|---|
| Amino Acid | Strongly Similar and Optimal Substitution | Rank of Order to Change | Comment |
| I | L, V | 1 | 50:50 substitution |
| L | I, V | 2 | 50:50 substitution |
| V | I, L | 3 | 50:50 substitution |
| A | G | 4 | |
| G | A | 5 | |
| D | E | 6 | |
| E | D | 7 | |
| W | Y | 8 | |
| Y | W | 9 | |
| S | T | 10 | |
| T | S | 11 | |
| K | R | 12 | |
| R | K | 13 | |
| N | Q | 14 | |
| Q | N | 15 | |
| F | Y | 16 | |
| M | L | 17 | First methionine cannot change |
| H | | Na | No good substitutes |
| C | | Na | No good substitutes |
| P | | Na | No good substitutes |

First, any conserved amino acids in the protein that should not be changed is identified and "marked off" for insulation from the substitution. The start methionine will of course be added to this list automatically. Next, the changes are made.

H, C and P are not changed in any circumstance. The changes will occur with isoleucine first, sweeping N-terminal to C-terminal. Then leucine, and so on down the list until the desired target it reached. Interim number substitutions can be made so as not to cause reversal of changes. The list is ordered 1-17, so start with as many isoleucine changes as needed before leucine, and so on down to methionine. Clearly many amino acids will in this manner not need to be changed. L, I and V will involve a 50:50 substitution of the two alternate optimal substitutions.

The variant amino acid sequences are written as output. Perl script is used to calculate the percent identities. Using this procedure, variants of the SCW polypeptides are generating having about 80%, 85%, 90% and 95% amino acid identity to the starting unaltered ORF nucleotide sequence of SEQ ID NOS: 1, 3, 5 and 40-71.

All publications and patent applications in this specification are indicative of the level of ordinary skill in the art to which this invention pertains. All publications and patent applications are herein incorporated by reference to the same extent as if each individual publication or patent application was specifically and individually indicated by reference.

The invention has been described with reference to various specific and preferred embodiments and techniques. However, it should be understood that many variations and modifications may be made while remaining within the spirit and scope of the invention.

SEQUENCE LISTING (456 sequences)

SEQ ID NO: 1 - DNA, 1266 bp, Zea mays
atgaggcggtgggtcttagccatcgccattcccattctcgccgctgcttcggcggcggcgctgttccttggggctgaggcccaggcggtccagcagggccaccagacagagaggatctcaggaagtgctggtgacgtgttggaagataaccctgttgggaggctcaaggtttacgtgtatgatctccccagtaaatacaacaagaagctggtgaagaaggatcctaggtgcctgaaccacatgtttgctgctgagatcttcatgcaccggttcctgttgtcaagtgctgtccgaacatttaatcctgaagaagcagattggttctacactcccgtatacgccacatgtgatctgactccttcgggtcttccccttcccttcaaatctccacgcatgatgcgcagcgcaattgagctgattgccacgaactggccttactggaacagatcagagggtgcagatcatttctttgtcacgccccatgactttggtgcttgctttcattatcaggaagagaaagcaatcggacggggaatccttcccttgcttcagcgtgctacactggttcagacctttggacagaagaaccatgtctgcctgaagggcgggtccatcacaatcccaccatttgcacctccccagaaaatgcaggctcaccttatccccttggacacccctcggtctatcttcgtgtacttccgtggtctgttctacgacaccagcaacgatcctgagggtggttactatgcgagaggtgctcgtgcatcagtctgggagaacttcaagaacaacccgctcttcgacatctcgactgatcacccaccgacttactacgaagacatgcagcgttcagtgttctgcctgtgccccttgggctgggctccatggagccccaggctggtggaagctgtggttttcggctgcatcccggtgatcatcgccgacgacattgtcctgccctttgcggacgccatcccgtgggaggagattggtgtgtttgtcgccgaggaggatgtcccgaagctggacagcatcctgacgtccatcccaacagatgttatactgaggaagcagcgtctcctcgcgaacccggccatgaagcaggccatgctgttcccccagcctgctcaggcgggagatgcattccaccagatcctaaacgggctcgcgcgcaagctcccacatggtgacaacgtcttcttgaagcccggggagagggtcctgaactggaccgccggaccgccaggcgacctgaagccttggtag

SEQ ID NO: 2 - protein, 421 aa, Zea mays
MRRWVLAIAIPILAAASAAALFLGAEAQAVQQGHQTERISGSAGDVLEDNPVGRLKVYVYDLPSKYNKKLVKKDPRCLNHMFAAEIFMHRFLLSSAVRTFNPEEADWFYTPVYATCDLTPSGLPLPFKSPRMMRSAIELIATNWPYWNRSEGADHFFVTPHDFGACFHYQEEKAIGRGILPLLQRATLVQTFGQKNHVCLKGGSITIPPFAPPQKMQAHLIPLDTPRSIFVYFRGLFYDTSNDPEGGYYARGARASVWENFKNNPLFDISTDHPPTYYEDMQRSVFCLCPLGWAPWSPRLVEAVVFGCIPVIIADDIVLPFADAIPWEEIGVFVAEEDVPKLDSILTSIPTDVILRKQRLLANPAMKQAMLFPQPAQAGDAFHQILNGLARKLPHGDNVFLKPGERVLNWTAGPPGDLKPW

SEQ ID NO: 3 - DNA, 534 bp, Zea mays
gtggaccggcccgtggcgtacaaggaggtgctgacgacgtgggcgaaatgggtggaccgcaacatcgaccccaacaggacgaccgtcttcttcatgggcatgtctcccaaccacatcaccatttgtattgagcagcatggtgcattgagcaggcctgaggcttggggcaacaagggcgggatcaagtgcgccatggagacgctgccgatcgcgagcaaccgcagcgcggcgctggacgtgggcacggactggcgcctctacgcgggggcgcgggaggtgctgcccacgctgcgccgggtgcccgtccacttcgtcgacatcaccgcgctgtcggagctgcgcaaggacgcgcacacctcggtgcacacgctgcgccaggggaagctgctcaccccggagcagcaggccgaccccaagacctacgccgactgcatccactggtgcctcccgggcctgcccgacacctggaaccagttcctctacgcccgcatcgcatccagcccatggcccaacgacgcccaggcccagcagtag

SEQ ID NO: 4 - protein, 177 aa, Zea mays
VDRPVAYKEVLTTWAKWVDRNIDPNRTTVFFMGMSPNHITICIEQHGALSRPEAWGNKGGIKCAMETLPIASNRSAALDVGTDWRLYAGAREVLPTLRRVPVHFVDITALSELRKDAHTSVHTLRQGKLLTPEQQADPKTYADCIHWCLPGLPDTWNQFLYARIASSPWPNDAQAQQ

SEQ ID NO: 5 - DNA, 1077 bp, Zea mays
atgggcacgggcgcggtggcggtggcggcgccggaccgggccaagcagcggcgggccggccacctgtggaagaaggcactgctccacttctccctctgcttcgtcatgggcttcttcacgggcttcgcgccttcctcctcctcctcctggaagtccgccgccgccaccccccagcaccacccgccgcaccaccgcctcgccgcctcccgcgtggccgtcgacgcgcgcgccaccctgtcgccgcccgcggaggccgccgatgcgctctccgccggcgccacggtggacttgggcgacgacgaggaggacgccgcccagcgccgcctcctgatcgtggtcaccaccacgcgcggggagcgccgccgccgccggggcgagctgctgcgcctcgcccacacgctgcgcctcgtgcgcccgcccgtcgtctgggtcgtcgtcgagcccgccgccgacgcgcccgccaccgctgaggtgctccgcggcaccggcgtcatgtacaggcacctcgccttcaagcccgaggacaacttcaccaccgccgacgccgaggctcacgtgcagcggaacgccgcgctcgcgcatgtcgagaagcaccgactcgccggcgtcctgcacttcgccgacgccgccggcgtctacgacgtcggcttcttcgaacagatccgccagatcgaggcgtttggtacatggcctgtggcaacaatgtcggcgggcgagaagaaagtggtagtggagggtccactgtgcagtgcctcaaaggtcgtcggttggttctcaagggacttcaacgacgggaccacccgttcagtgacgtataacacggaagctgacctgaatcctgctggtgccgctggtacacgagcccacacgatcgacgtctcaggttttgcgttcaatagctctattttgtgggatcctgagcggtggggacggccaacgtcattaccagacacttcacaggactcgatcaagttcgtgcaagaagtgctacttgaagaccgagctaagctgaaggggatcccctccgactgctcccagatcatggtgtggcagtacagcgtgcccagctcgcgatag

SEQ ID NO: 6 - protein, 358 aa, Zea mays
MGTGAVAVAAPDRAKQRRAGHLWKKALLHFSLCFVMGFFTGFAPSSSSSWKSAAATPQHHPPHHRLAASRVAVDARATLSPPAEAADALSAGATVDLGDDEEDAAQRRLLIVVTTTRGERRRRRGELLRLAHTLRLVRPPVVWVVVEPAADAPATAEVLRGTGVMYRHLAFKPEDNFTTADAEAHVQRNAALAHVEKHRLAGVLHFADAAGVYDVGFFEQIRQIEAFGTWPVATMSAGEKKVVVEGPLCSASKVVGWFSRDFNDGTTRSVTYNTEADLNPAGAAGTRAHTIDVSGFAFNSSILWDPERWGRPTSLPDTSQDSIKFVQEVLLEDRAKLKGIPSDCSQIMVWQYSVPSSR

SEQ ID NO: 7 - DNA, 972 bp, Zea mays
atgaaggcaatggccgggccaaagctgctcgtcgtccacgcgtcgtcgaacaaggccctgaacgggatggcgcccacgtcgccggcgtcgcccggctggtcgcggtgcctgtggctggtggtgttcctggccttgttcacctgcgtgtccctcctgaccgtgctctccacggcgcgcgcctcggccggggcgccggcgtgccaggcggcgtcgctcacggccagcgctgccggcgccacggaggccggcctgccgcggcacgtgttcgacgcgctggtgcagtacgcggcggcggcagggaacttgtcgtcgagcatgccggagccggacgtgcgcgcgatcgcgtcggtgctccggcggcgcgcgccgtgcaacctgctggtgttcgggctgggcgcggagacgccgctgtggcgcgcgctcaaccacggcgggcgcacggtgttcctggacgagaacccgtactacgtggcccacctggagggtaagcacccggggctggaggcctacgacgtggcctacgccacggcggtgcgcgagctccccgacctcctcgacgccgcccgtgccgcgcgcgccgctgagtgccgccccgtccagaacctgctcttctccgagtgccgcctcgccatcaacgacctccccaaccagctctacgacgtcgcctgggacgtcatcctcgtcgacggcccgcgcgggttcatggaggggtcgccggggaggatgtcggcgatctactcggctgcggtgatggcgcggaccaagggcgcggagacggaggtgatggtgcacgactacgagcgggaggtggagcgcgcgtgcggccgggagttcctgtgtgacgagaaccgggtcacggcgaccagcacgccgtcgctcggccacttcctcgttcgcggcggcgccgccgccaaccgggaagccttctgcgggccgcccgccggcgccgcccagaaatcgaaaccgagctaa

SEQ ID NO: 8 - protein, 323 aa, Zea mays
MKAMAGPKLLVVHASSNKALNGMAPTSPASPGWSRCLWLVVFLALFTCVSLLTVLSTARASAGAPACQAASLTASAAGATEAGLPRHVFDALVQYAAAAGNLSSSMPEPDVRAIASVLRRRAPCNLLVFGLGAETPLWRALNHGGRTVFLDENPYYVAHLEGKHPGLEAYDVAYATAVRELPDLLDAARAARAAECRPVQNLLFSECRLAINDLPNQLYDVAWDVILVDGPRGFMEGSPGRMSAIYSAAVMARTKGAETEVMVHDYEREVERACGREFLCDENRVTATSTPSLGHFLVRGGAAANREAFCGPPAGAAQKSKPS

SEQ ID NO: 9 - DNA, 1230 bp, Zea mays
aactaccaggacctggtgttcgccccgtacggctcccggtggcgcgcgctacggaagctgtgcgcgctccacctcttctccgccaaggccctggacgacctgcgcggcgtcagagagggcgaggtagcgctcatggtgagggagctcgcccggcagggagagcgaggacgggccgccgtggcgctgggccaggtggccaacgtctgcgcgaccaacacgctggcccgggcgcccgtgggccggcgcgtgttcgccgtcgacggaggggagggcgcgagggagttcaaggagatcgtgctcgaggtgatgcaggtgggcggggtgctcaacgtcggcgacttcgtgccggcgctccggtggctcgacccgcagggcgtggcggccaagatgaagaagctgcaccgccggttcgacgacatgatggacgagatcattgcaggttatagggaggccaggagggttgcggcagacggagaggagagcaaggatttgcttggcttgctgctgtcgatggttgacgagcggccgttcgacagcggggaagaagtcaggatcaccgaaaccgatgtcaaggcactcattttgaacctgttcgtggcagggaccgacacgacgtcgaccatagtggagtggtctctcgcagagctgatccgccacccggaaatcctgaggcaagcgcaggaggagatggacgcggtggccgggcgcgggaggctggtcacggagtcggacctccgaagcctcaccttcttcaacgcggtcatcaaggagacgttccgcctgcacccgtcgacgccgctctccctaccgcgcatggccgccgaggagtgcgaggtcgcgggctaccgcgtccccaggggctcggagctgctggtcaacgtgtggggcatcgcccgcgacccggcgctgtggcctgacccgctggagttccggccggccaggttcctgccgggcgggtcgcatgcggacgtggacgtcaaaggcgccgacttcgggctcatcccgttcggcgccggccggaggatctgcgccggcctcagctgggggctgcggatggtcacgctcaccagcgccaccctggtgcacgcgttcgactgggagttgccggcagggcagacgccggacaagctgaacatggaggaggccttcaccctcctgctgcagcgggctgttccgttagtggctcgtccagtacccaggctgctgccgtcggcgtatgagatcgcatag

SEQ ID NO: 10 - protein, 409 aa, Zea mays
NYQDLVFAPYGSRWRALRKLCALHLFSAKALDDLRGVREGEVALMVRELARQGERGRAAVALGQVANVCATNTLARAPVGRRVFAVDGGEGAREFKEIVLEVMQVGGVLNVGDFVPALRWLDPQGVAAKMKKLHRRFDDMMDEIIAGYREARRVAADGEESKDLLGLLLSMVDERPFDSGEEVRITETDVKALILNLFVAGTDTTSTIVEWSLAELIRHPEILRQAQEEMDAVAGRGRLVTESDLRSLTFFNAVIKETFRLHPSTPLSLPRMAAEECEVAGYRVPRGSELLVNVWGIARDPALWPDPLEFRPARFLPGGSHADVDVKGADFGLIPFGAGRRICAGLSWGLRMVTLTSATLVHAFDWELPAGQTPDKLNMEEAFTLLLQRAVPLVARPVPRLLPSAYEIA

SEQ ID NO: 11 - DNA, 1734 bp, Zea mays
atgggggcggcggcgccatcgtcgtggcttattgcgttcatcctgttcttcggcacgttggtagcgttgccgcagtcgtcacacggcggcggcacaaccagacactacaccttcaacgtgacgatgaagaaggtgacgcggctgtgcaccacccgcgccatcccgacggtgaacggccagttccccggccccaagatagtcaccagggagggcgaccgcgtcgtcgtcaaggtgctgaacaatgtcaaggacaacgttaccatccactggcacggcgttcggcagctgcgcacggggtggtcggacgggccagcgtacgtgacgcagtgccccatccagacggggcagagcttcgtgtacaacttcaccatcacggggcagcggggcaccctgttctggcacgcgcacgtctcctggatgcgcgccacgctctacggggccatcgtcatcctccccaagcgcggcgtgccatacccgctcccggttaaaccctacaaggacgtcccagtcatcttcggagagtggttcaacgcggatccagagacaattgtcgcccaggcgcttcagactggagcaggcccaaacgtgtcggacgccttcaccatcaacgggctcccgggccctttgtacaactgctccagcaaagacacgttcaagctgaaggtgctgcccggcaaatggtacctgctccgtctcatcaacgctgcgctcaacgacgagctcttcttctccgtcgccaaccacacgctcaccgtcgtcgacgtcgacgccgcctacgtcaagccgttccgcacggacatcgtgctcatcacgccgggccagaccaccaacgtgctcctgcgcgccgagcccgacgcggggtgccccgcggccacgcacctcatgctggcgcgcccctacggcacgggccagccgggcaccttcgacaacaccaccgtcgccgccgtgctcgagtacgcgccgccgggccacatcaggagcctcccgctcttccggccctcgctccccgcgctcaacgacacggccttcgccgcgaactacagcgccaggctccggagcctggccaccccggactacccggccaacgtgccccgcgccgtggaccgctccttcttcttcgccgtcgggctcggcaccaacccctgccccgtcaaccagacgtgccaggggcccaacgggaccatgttcacggcgtccatgaacaacgtgtccttcaacatgcccaccaccgcgctcctgcaggcgcactacggcagcgtcgccggcgtgtacacgcccgacttccccgtcgcgccgctcgagccgttcaactacactggcacgccgccgaacaacaccaacgtctcccacgggaccaaggtggtggtgctggactacaataccagcgtcgaggtggtgctgcaggccaccagcatcctcggcgccgagagccacccgctgcacctccacggattcgacttcttcgtcgtcggccaaggcttcggcaactacgactcgtccaaggacccacccaagtttaacctagtcgacccggtgcaaaggaacaccgtcggcgtgccggcagggggctgggtcgccatcaggttcttcgcggataatcccggtgtttggttcatgcattgccatctggaggtgcacacaagctgggggttgaagatggcatgggtggtcaacgatggcccgttgcctgagcagaagctgatgccgccgccggccgatcttcccaagtgctga

SEQ ID NO: 12 - protein, 577 aa, Zea mays
MGAAAPSSWLIAFILFFGTLVALPQSSHGGGTTRHYTFNVTMKKVTRLCTTRAIPTVNGQFPGPKIVTREGDRVVVKVLNNVKDNVTIHWHGVRQLRTGWSDGPAYVTQCPIQTGQSFVYNFTITGQRGTLFWHAHVSWMRATLYGAIVILPKRGVPYPLPVKPYKDVPVIFGEWFNADPETIVAQALQTGAGPNVSDAFTINGLPGPLYNCSSKDTFKLKVLPGKWYLLRLINAALNDELFFSVANHTLTVVDVDAAYVKPFRTDIVLITPGQTTNVLLRAEPDAGCPAATHLMLARPYGTGQPGTFDNTTVAAVLEYAPPGHIRSLPLFRPSLPALNDTAFAANYSARLRSLATPDYPANVPRAVDRSFFFAVGLGTNPCPVNQTCQGPNGTMFTASMNNVSFNMPTTALLQAHYGSVAGVYTPDFPVAPLEPFNYTGTPPNNTNVSHGTKVVVLDYNTSVEVVLQATSILGAESHPLHLHGFDFFVVGQGFGNYDSSKDPPKFNLVDPVQRNTVGVPAGGWVAIRFFADNPGVWFMHCHLEVHTSWGLKMAWVVNDGPLPEQKLMPPPADLPKC

SEQ ID NO: 13 - DNA, 666 bp, Zea mays
atgatggcatcctccctcctctttgttgtcgtcctcctcgcagcgctgtcatcgccgccgccgtcagccgtcctggcggcggacgactacggcaccacgcacctgcacttcttcatgcacgacgtggtgaccgggagcaacccgacggcggtgcaggtgatcaagggcgcggggtcgtcggtcgtcccggggctggcgttcggcgacaccacggtgatcgacgacgcgctgacggagacgtcgtcgcccacgtccgccgccgtgggccgcgctcagggcttctacatgatgtcgtcgcagtcgggcatcgtgctcatggtgtgcgccaacctgctgctcaccgcgggggaccacaacggcagcacgctcgcggtggtgggccgggacgacgtcgcggcggacgtgcgggagctctccgtcgtcggcggcacgggccggttcaggatggccaccggctacgtgctgtggaagacgtccagcatgaacgggcctgacgctaccgtcgagctcgacgtgcacgtgaggacggccacaaccgccgccacgggtagcggcaccactggtgccttctcgggcgccgctgccaagcgggtcggagcagggtgggtcattgcgtgcgccgtcgccgtcgttggggcggtggttggatccggcgtctggtggtga

SEQ ID NO: 14 - protein, 221 aa, Zea mays
MMASSLLFVVVLLAALSSPPPSAVLAADDYGTTHLHFFMHDVVTGSNPTAVQVIKGAGSSVVPGLAFGDTTVIDDALTETSSPTSAAVGRAQGFYMMSSQSGIVLMVCANLLLTAGDHNGSTLAVVGRDDVAADVRELSVVGGTGRFRMATGYVLWKTSSMNGPDATVELDVHVRTATTAATGSGTTGAFSGAAAKRVGAGWVIACAVAVVGAVVGSGVWW

SEQ ID NO: 15 - DNA, 1635 bp, Zea mays
atggaagagcagcagccccgcccccgcccaagcatcatgttcgtcctgtcgtcgctcgccaagaataacccagagtccgtgctggcgctcatcgcggtgctcaccgtcgtcgccctgcgccacttgatctcctcatggcggcagcaggcccggctgcccccgtcaccgacgagcctcccggtgatcggccacctgcacctgctccgcccgccggtgcaccgcaccttccaggagctggcgtcccggatcggtccgctgatgcacatccgcctcggctccacgcactgcgtggttgccagcaccccggaggtggccagcgagctcatccgcggccacgagggcagcatctcggagcggccgctcacggcggtggcccgccagttcgcgtacgactcggccggcttcgccttcgcgccctataacacgcactggcgcttcatgaagcgcctctgcatgtcggagctgctcggcccgcgcactgtcgagcagctgcgccccgtccgccgcgccggcaccgtgtccctgctcgccgacctgctggcgtcgtcggcgcggggggagacggtggacctcacccgccatctcatccgcctctccaacacctccatcatccggatggtggccagcaccgtgcccggaagcgtcaccgacgaggcgcaggaggtggtcaaggacgtggccgagctcgtgggcgccttcaacgtcgacgactacatctccctagtccgtggctgggatctccagggcctccgcaggagagccgctggcgtccaccgccgcttcgacgcgctgctggaggacatcctcaggcacaaggaggaggcgagggcggcgcgaaggctcgaccaagacgacgacggacgtggcagcagcaagcaggacaagaagcaggccacgcacagcaaggacctgctcgacatcctcatggacaaggcagacgacccggcggcggagatcaagctcacccgggaaaacatcaaggctttcatcatcgacgtggtgactgctggttcagacacgtcggccgccatggtagagtggatgctggcggagctgatgaaccacccggagacgctgcgtaaggtggcggaggagatcgacgcggtggtcggcggcgacaggatcgccagcgaagcggacctgccacagctgccgtacctgatggcggcgtacaaggagacgttgcgtctgcacccggcagcgcccatcgcgcaccgacagtcgagcgaggagatggtggtgcgcggcttcacggtgccgccgcagacggcggtgttcatcaacgtgtgggccatcgggcgcgacccggcgtactgggaggagcccctagcgttccggccggagcggttcatgcccggcggcgccgccgagagcctggagccccgtgggcagcactttcagtacatgcccttcggcagcggccgccggggatgccccggcatgggcctggcgctacagtccgtgccggccgtgctggcggcgctcgtgcagtgcttccactgggccaccgtcgacggcgacggcggggtgaacaagatcgacatgtcggagtcggacgggctggtgtgcgctcgcaagaagccgcttctgctccgccccacgcctcgcctcacccccttcccggccgtcgtctag

SEQ ID NO: 16 - protein, 544 aa, Zea mays
MEEQQPRPRPSIMFVLSSLAKNNPESVLALIAVLTVVALRHLISSWRQQARLPPSPTSLPVIGHLHLLRPPVHRTFQELASRIGPLMHIRLGSTHCVVASTPEVASELIRGHEGSISERPLTAVARQFAYDSAGFAFAPYNTHWRFMKRLCMSELLGPRTVEQLRPVRRAGTVSLLADLLASSARGETVDLTRHLIRLSNTSIIRMVASTVPGSVTDEAQEVVKDVAELVGAFNVDDYISLVRGWDLQGLRRRAAGVHRRFDALLEDILRHKEEARAARRLDQDDDGRGSSKQDKKQATHSKDLLDILMDKADDPAAEIKLTRENIKAFIIDVVTAGSDTSAAMVEWMLAELMNHPETLRKVAEEIDAVVGGDRIASEADLPQLPYLMAAYKETLRLHPAAPIAHRQSSEEMVVRGFTVPPQTAVFINVWAIGRDPAYWEEPLAFRPERFMPGGAAESLEPRGQHFQYMPFGSGRRGCPGMGLALQSVPAVLAALVQCFHWATVDGDGGVNKIDMSESDGLVCARKKPLLLRPTPRLTPFPAVV

SEQ ID NO: 17 - DNA, 1566 bp, Zea mays
atgatggtcctgtcgtcgctcgccaagaataacccagaggccgtcctggcgctcatcgcgttcgtcaccgtcgtcgccctgcgccacttgatctcttcatggcggcagcacggccggctgcccccggggccgacgagccttccggtgatcggacacctgcacctgctccgcccgccggtgcaccgcaccttgcaggagctggcgtcccggatcggtcccctgatgcacatccgccttggctccacaaactgcgtggtggccagcagcccagaggtggccagcgagctcatccgcggccacgagggcagcatctcggcgcggccgtttacggcagtggcccgcaagttctcctacgactccgccggcttcgtcttcgagccctacaacacgcactggcgcttcatgaagcgcctctgcatgtcggagctactcggcccacgcaccgtcgagcagctgcgccccgtccgccgcgctgtcaccgtgtccctggtctccgacctgctggcgtcgtcggcgcgcggggagacggtggacatcacccgccatctcatccgcctcacaaacacctccatcatccggatggtggccagcaccgtgtccggcagcgtcaccgacgaggcgcacgagctggccaaggccgtaattgaggtcgtgggcgccttcaacgtcgacgactacatcgccgtggtccgtggctgggatttccagggcctcggcagaaaagccgccgacgtccaccgccgcttcgacgcgctgctggaggacatcctgaggcacaaggaggaggcgagggcagcgcgaaggctcgacgacggacatggcaagcaggccacgcacagcaaggacctgctcgacatcctcatggacaaggcggaggacccggcggcggaggtcaagctcacccgggaaaacatcaaggcgttcgtcatcgacgtggtgacgtctggttcagacacgtcggcggccatggcagagtggatgctggcggagctgatgaaccacccggagacgctgcgcaaggtggtagaggagatcgacgctgtggtcggcggcggcaggatcgccagcgaggcggacctgccgcagctgccgtacctgatggcggtatacaaggagacgctgcgtctgcacccggcggggcccatcgcgcaccggcagtcgacggaggagatggtggtacacggtttcaccgtgccgccgcagtcgacggtgcttatccacgtgtgggccatcggacgcgacccggcctactgggaggagcccctgttattccggccggaacggttcatgccaggcggcgctgccgagagcctggagccccgcgggaagcacttccaatacattcccttcggcagcggccgtcggggatgtcccggcatgggcctcgcgatgcagtcagtgccggccgtggtagcggcactcgtgcagtgcttttattgggccaccgtcgacggcggggtggacaagatcgacatgtcggagtcggacgggctggtgtgtgctcgtaagaagccacttctgctccgacccacatctcgcctcacccccttcccgcccgtcgtatag

SEQ ID NO: 18 - protein, 521 aa, Zea mays
MMVLSSLAKNNPEAVLALIAFVTVVALRHLISSWRQHGRLPPGPTSLPVIGHLHLLRPPVHRTLQELASRIGPLMHIRLGSTNCVVASSPEVASELIRGHEGSISARPFTAVARKFSYDSAGFVFEPYNTHWRFMKRLCMSELLGPRTVEQLRPVRRAVTVSLVSDLLASSARGETVDITRHLIRLTNTSIIRMVASTVSGSVTDEAHELAKAVIEVVGAFNVDDYIAVVRGWDFQGLGRKAADVHRRFDALLEDILRHKEEARAARRLDDGHGKQATHSKDLLDILMDKAEDPAAEVKLTRENIKAFVIDVVTSGSDTSAAMAEWMLAELMNHPETLRKVVEEIDAVVGGGRIASEADLPQLPYLMAVYKETLRLHPAGPIAHRQSTEEMVVHGFTVPPQSTVLIHVWAIGRDPAYWEEPLLFRPERFMPGGAAESLEPRGKHFQYIPFGSGRRGCPGMGLAMQSVPAVVAALVQCFYWATVDGGVDKIDMSESDGLVCARKKPLLLRPTSRLTPFPPVV

SEQ ID NO: 19 - DNA, 1758 bp, Zea mays
atggccatggcgatctcctctgctcttccgtgctccctcctcgtggcggccctgatgctcctcgcctccgtcgtccaagtgcaaggcatcacgaggcactacgacttcaatgtgaccatggcgaacgtgacacggctgtgcgccagcaagagcatcatcacggtgaacgggcagttccccgggcccaagatcgtggcgagggaaggcgaccggctcgtcatccgcgtcaccaaccacgcccagcacaacatctcgctgcactggcacggcatccggcagctgcgcacggggtgggcggacgggccggcgtacatcacgcagtgcccgatccagacggggcagagttacgtgtacaactacaccgtcgtggggcagcgcggcacgctgtggtggcacgcgcacatctcctggctgcgcgccaccgtctacgggcccctcgtcatcctgcccaagctcggcgtcccctacccgttcccggcgccctacaaggaggtccccgtcatcttcggtgagtggtggctggcggacacggaggtggtgatcaagcaggcgcttcagctcggcgctggccccaatgtctctgacgcccacaccatcaacggcctgccagggccgctctacaactgctctgccaaagacacgtacaagctgaaggtgaagcccgggaagacgtacatgctgcgcctcatcaacgcggcgctcaacgacgagctcttcttctccgtcgccaaccactcgctcacggtcgtcgaggtcgacgccgtctacgtcaagcccttcaccgtcgacacgctgctcatcgcgccgggccagaccaccaacgtgctgctcgccgccaagccgtcctacccgggcgccaactactacatgtccgccgcgccctactccaccgccaggccggccaccttcgacaacaccaccgtcgccggcatcctcgagtacgagctgtaccccgacgcgccccggccctccgcctccgcggggagcttcaacgaggccctgccgctctacagaccgaccctgccgcagctcaacgacaccagcttcgtcggcaacttcacggccaagctccgcagcctcgcgacgccgcggtacccggcggccgtgccgcggacggtggacaggcggttcttcttcgcggtcgggctcggcacgcacccgtgccccgccaacgccacgtgccagggccccaccaacaccacgcagttcgcggcgtccgtcaacaacgtctccttcgtgctccccaccaaggcgctgctgcactcccacttcaccggcctgtccagcggcgtctactcgccggacttccccgtcgcgcccctggcgccgttcaactacacggggacgccgcccaacaacaccaacgtggccagcgggaccaagctcatggtcgtcccgtacggcgccaacgtggagctcgtcatgcagggcaccagcatcctcggcgtcgagagccacccgctgcacctgcacggcttcaacttcttcgtggtcggccaagggtacggcaactacgacccggtcaacgacccgcccaagttcaacctcgtcgaccccgtcgagcgcaacaccgtcggcgtgccggccggcggatgggtggccatccgcttcctcgccgacaaccccggggtctggttcatgcattgccatttggaggcgcacacaacatggggcctcaggatggcatggttggtgctcgacggcagcctcccgcaccagaagctgctcccgccgccgtcagacttacccaaatgttga

SEQ ID NO: 20 - protein, 585 aa, Zea mays
MAMAISSALPCSLLVAALMLLASVVQVQGITRHYDFNVTMANVTRLCASKSIITVNGQFPGPKIVAREGDRLVIRVTNHAQHNISLHWHGIRQLRTGWADGPAYITQCPIQTGQSYVYNYTVVGQRGTLWWHAHISWLRATVYGPLVILPKLGVPYPFPAPYKEVPVIFGEWWLADTEVVIKQALQLGAGPNVSDAHTINGLPGPLYNCSAKDTYKLKVKPGKTYMLRLINAALNDELFFSVANHSLTVVEVDAVYVKPFTVDTLLIAPGQTTNVLLAAKPSYPGANYYMSAAPYSTARPATFDNTTVAGILEYELYPDAPRPSASAGSFNEALPLYRPTLPQLNDTSFVGNFTAKLRSLATPRYPAAVPRTVDRRFFFAVGLGTHPCPANATCQGPTNTTQFAASVNNVSFVLPTKALLHSHFTGLSSGVYSPDFPVAPLAPFNYTGTPPNNTNVASGTKLMVVPYGANVELVMQGTSILGVESHPLHLHGFNFFVVGQGYGNYDPVNDPPKFNLVDPVERNTVGVPAGGWVAIRFLADNPGVWFMHCHLEAHTTWGLRMAWLVLDGSLPHQKLLPPPSDLPKC

SEQ ID NO: 21 - DNA, 1116 bp, Zea mays
atggcgcgtgcggcggcgtcggtggccgcggcgctgctcgtcgtgctcggcgtggcagcgtcggtggcgacggcgcagatggagacctgcagcggcgacctcccacccgtgctcgccgccaactactccggcctggcctgccagccggtctggaacaacttcgtgctccggtaccaccaggacaaggacaacgtgctgcgggtggtgctgtccacgatgtacagcacggggtgggtgggcatggggttctccagggacggcctcatggtcggctccagcgccatggtggggtggatcggcaagaaggggctcccccacgtccggcagttcgcgctgcggggcaagagcagctccaaggtggtggtcgaccgtggcttcctcgtttccaacgaccacgaccacactgtcgtggtgcagcaggccaagatctacctcgccttccagctcaggttctcctaccgcctcacccaccagcacatcgtcatggccttcggcaacagcatccccgtcaagaacaggctcaccaggcaccaggacaagacctccttcaccttcgatttcacaacgggcagagcttcggtggacgggtccttcccatacggcctgcggcgtgcgcacggcgcgctgaacgtgttcgcgtggggagtcctgctgcccatcggcgccatcctggcgcgctacttccggcggatggacccgctctggttctacctccacgtgggcgtccagctcgccggcttcatcatcggcctggccggcgtcgtcgccggggtggcgctgtacaacaagatccaggccgacatccccgcgcacagggggctcggcgtcttcgtcctcttcctcggcatcctgcaggtgctggccttcttcctgcgccccagcgccgactccaagtaccgcaagtactggaactggtaccaccactgggcgggcaggctggcgctcttcttcgccgccgtcaacatcgtgctcgggatccacgtcggcggcgccgacagctcatggaagatcggatacggcttcagcctggccgtcctcctcgtcgccgtcgccgcgctcgagttcatgctgtggacgaggtggtccaagaacagcaccgccaccccgacgtactag

SEQ ID NO: 22 - protein, 371 aa, Zea mays
MARAAASVAAALLVVLGVAASVATAQMETCSGDLPPVLAANYSGLACQPVWNNFVLRYHQDKDNVLRVVLSTMYSTGWVGMGFSRDGLMVGSSAMVGWIGKKGLPHVRQFALRGKSSSKVVVDRGFLVSNDHDHTVVVQQAKIYLAFQLRFSYRLTHQHIVMAFGNSIPVKNRLTRHQDKTSFTFDFTTGRASVDGSFPYGLRRAHGALNVFAWGVLLPIGAILARYFRRMDPLWFYLHVGVQLAGFIIGLAGVVAGVALYNKIQADIPAHRGLGVFVLFLGILQVLAFFLRPSADSKYRKYWNWYHHWAGRLALFFAAVNIVLGIHVGGADSSWKIGYGFSLAVLLVAVAALEFMLWTRWSKNSTATPTY

SEQ ID NO: 23 - DNA, 732 bp, Zea mays
atggccatggccacggccggcgccgtcatcgcggcatgcatcctggcgctgctggccccgccgccggcgcgcgcggcgggcggcgggcggtgcgcgggtgagtccttctccgcgaaccgcgcctacgcggcgtgcaacgacctgccccgcctcggcgcgtccatgcactggacctacgaccgcgcgtcgggcgacctccacgtcgcgttcgtcgccgcgccggccgcgccgggcggctgggtggcgtgggcgctcaacccgtcgggcgacggcatggcgggcgcgcaagcgctcgtggcggggcccttccccgacggcggcggcacgtgggccgtgcggacgtacaacgtgtccgggtacgcgctcggggagcccgggcccatcgcgttcccggcgtcggacctcgccgccgagctcggcgccgacggccgcgtcagggtcttcgggacgctcggcctcggcgccgccgccgtaggcggcgggggcgtgctgctgaaccaggtgtggcaggtcggcgccgccgtctccagcggcggcgtcccggcgccgcacgccatgggggcggacaacctcgccgccaaggccaagctggacctgctgagggcgaccaccgtagccgccggagccgacagcgccaccaggaagcgcaatgtgagagctctctctctctgctcggtctcgctctcactctcactttgtttgccttttgctccgcagtctgctgtaatgtaa

SEQ ID NO: 24 - protein, 243 aa, Zea mays
MAMATAGAVIAACILALLAPPPARAAGGGRCAGESFSANRAYAACNDLPRLGASMHWTYDRASGDLHVAFVAAPAAPGGWVAWALNPSGDGMAGAQALVAGPFPDGGGTWAVRTYNVSGYALGEPGPIAFPASDLAAELGADGRVRVFGTLGLGAAAVGGGGVLLNQVWQVGAAVSSGGVPAPHAMGADNLAAKAKLDLLRATTVAAGADSATRKRNVRALSLCSVSLSLSLCLPFAPQSAVM

SEQ ID NO: 25 - DNA, 1347 bp, Zea mays
atggtgatgaaagaagcagccgaagagcacgatggccgccgcgacgtgaccgtcacggtggagccggcgctgccggtgcagcaacaccgcctgccgctgtccaacctggacctcctcctgccgccgctcgacgtcagcctcttcttctgctacctccacccggcgcccaccgcgatcgctctcaaggaggcactggccaagacgctggtggcgtactacccgttggccggggaggtggtggccaacggcgatggggagccggagctgctctgcagcggccgcggcgtggacttcacggagacggccgcggccggagtcgagctgcgggaggtccggctgggcgccgtggacgaaggcgttgagaagctggtccctgttaagaagaccggcgtgacgatggcggtcaagctgagcaagttcacgtgcggcggcgccgtcgtcggctgcaccttcgaccaccgcgtctgcgacgcctactccttcaacatgttcctcgtcgcgtgggccgcagccgcccgtggcagctctgcgccaccaccgccggacccgtgcttccgccgctccctagtcgccccacgcgacacaccacatcggcgcgcgccgtccaccgacgccctcatcaaccgcctcttctctcctcgaagcgccgcgccaccgcctccacccgccgccgcaggctccgtcaaccggatctaccgcatagccgccgaggacatcgccgcgctgaaggcctcggcggggccggggcgcacgaagatggaggcgttcacggcgctcctgtggcagctctgcgcaagggcggcctccccgcgccagagccagtgctgcatgggcgtggtcgtggacgggcgcacccggatgttcccggacggcgccatgaaggcctacttcggaaacgtgctcaccatcccgtacggcgtcatcggctccgaagacctgcgctgcatggccctcgctgacgtggccgacgacgtgcaccggtgggtggcggaggccgccaccggcgaccatttccgcgggctcgtggactgggtggaggcgctgcggcctaagccggccgcggcgagggcgtacctgggagggaccggcggcaacgaggcgatggcgtgcatcgtgtcgtccggtatgagcttcccggtgggcaaggccgacttcgggactggcctccccgcgttcgcgtcgtaccatttcccgtggcccgccggcgccgggtacgtgatgccgatgccgagcgcgcgcgggaacggcgattgggtggtgtacgtgcacgtggcgccggaggtggcgaaggtgatggaggagtccaccgtgttccaagccctggtgaacagctatgcgtttgaatga

SEQ ID NO: 26 - protein, 448 aa, Zea mays
MVMKEAAEEHDGRRDVTVTVEPALPVQQHRLPLSNLDLLLPPLDVSLFFCYLHPAPTAIALKEALAKTLVAYYPLAGEVVANGDGEPELLCSGRGVDFTETAAAGVELREVRLGAVDEGVEKLVPVKKTGVTMAVKLSKFTCGGAVVGCTFDHRVCDAYSFNMFLVAWAAAARGSSAPPPPDPCFRRSLVAPRDTPHRRAPSTDALINRLFSPRSAAPPPPPAAAGSVNRIYRIAAEDIAALKASAGPGRTKMEAFTALLWQLCARAASPRQSQCCMGVVVDGRTRMFPDGAMKAYFGNVLTIPYGVIGSEDLRCMALADVADDVHRWVAEAATGDHFRGLVDWVEALRPKPAAARAYLGGTGGNEAMACIVSSGMSFPVGKADFGTGLPAFASYHFPWPAGAGYVMPMPSARGNGDWVVYVHVAPEVAKVMEESTVFQALVNSYAFE

SEQ ID NO: 27 - DNA, 843 bp, Zea mays
atggcgcggcggtccctggccctgctgctcgcgtcgtcgctcgccctgatggcggccgccgtcgcgtcggcggactcgtggctctacgacaaattcaacacggacggcaccgtccgcacccagtacgacgcgtcggggcaggaggtggcgatgctcagcctggaccgcagctctggcgccggcttcaactccaaggagcagtacctgtacggcgagttcagcgtccagatgaagctcatccccggcaactccgccggcaccgtctcgtgcttctacctctcgtcgggcgacggcgacgggcacgacgagatcgacatggagttcatgggcaacgcgagcgggcagccggtggtgctgaacacgaacgtgtgggccagcggcgacggcaagaaggagcaccagttcgacctctggttcgacccctccgccgactaccacacctacaccatcatctggaacccggccaacatcctgttcaaggtggacggcgacgtgatccggtgcttcaagcgctacgccgacctgccgtacccgagcgcgaggcccatggcgctgcacgccacgctgtgggacggcagctactgggccaccgagaagggcaaggtgccggtggactggtccgccgcgcccttcgtcgtctcctaccggggctactccgccaacgcctgcgtcagcggcggggcctgcggcggcggcggcgacgacgggtggatgagcaagcagcccgacgacgccgagtggggcaccatccggtgggccgagagcaactacatgcgctacaactactgcgacgacggctggcggttcccccagggcctcccgcccgagtgcagccgcagctaa

SEQ ID NO: 28 - protein, 280 aa, Zea mays
MARRSLALLLASSLALMAAAVASADSWLYDKFNTDGTVRTQYDASGQEVAMLSLDRSSGAGFNSKEQYLYGEFSVQMKLIPGNSAGTVSCFYLSSGDGDGHDEIDMEFMGNASGQPVVLNTNVWASGDGKKEHQFDLWFDPSADYHTYTIIWNPANILFKVDGDVIRCFKRYADLPYPSARPMALHATLWDGSYWATEKGKVPVDWSAAPFVVSYRGYSANACVSGGACGGGGDDGWMSKQPDDAEWGTIRWAESNYMRYNYCDDGWRFPQGLPPECSRS

SEQ ID NO: 29 - DNA, 1083 bp, Zea mays
atggaggccgccgaggctcctaactatgacagtattgtcaacagggatgagatcaccgacgctgcagctgcagcgttcgccaacccggagcaggtcccggagaagtacgtccggacggaggaggtccttgacggcgtcgtcgtcggcgcggacgagagctacgagctgccggtcgtcgacatggccaggctcctcgacccggagctggcgccgtcggaggtcgccaagctcggcgacgcctgccgaaactggggtttctttcagctgacaaaccatggagtggacgaagcggtggtgcagcggatgaaaaacgccacggtgcagttcttcagctccccgctggacagcaaggccaaggtggcggtccgagggaacggcttcgaaggattcgggcaccactacagcagagcgtccagcggcaagctggactgggcagagagcatgattctcatcacgcagccagtcaaggacaggaacatggagatgtggcctacaaatccacccacgttcagggacgcgctcgacgtctactcggtagagatgatcggcctcgcaatgcggctcctggggttcatggcggccgacctcggggtggagccggaggcgctgcaggacgccttcacggggaagcggcagagcatggcggtccaccactacccgccctgccgccagcgggagaaggtgatgggcatcacgccgcacacggacgggctgggcctcacgctgctgctgcacgtggacgacacgcccggcctgcagatccgcaggggcggcaggtggttccccgtgcgcccgctgccgggcgccttcgtcgtcaacgtcgccgacatcctggacgtgctcaccaacggcgcctacgccagcgtcgagcaccgagtgctcccggacgccgagagggctcggaccaccgtcgtcgtgttccaggaggcgtccgtcgggggcctggtggcgccgctgccggggctcctcgaccagcagggcgcgcgcgcgcgctacaggtccattgagatcgaggagtacatcaagggcaacttcaacgcgctggagcaagggacacggttcatccagagcctcaggatatag

SEQ ID NO: 30 - protein, 360 aa, Zea mays
MEAAEAPNYDSIVNRDEITDAAAAAFANPEQVPEKYVRTEEVLDGVVVGADESYELPVVDMARLLDPELAPSEVAKLGDACRNWGFFQLTNHGVDEAVVQRMKNATVQFFSSPLDSKAKVAVRGNGFEGFGHHYSRASSGKLDWAESMILITQPVKDRNMEMWPTNPPTFRDALDVYSVEMIGLAMRLLGFMAADLGVEPEALQDAFTGKRQSMAVHHYPPCRQREKVMGITPHTDGLGLTLLLHVDDTPGLQIRRGGRWFPVRPLPGAFVVNVADILDVLTNGAYASVEHRVLPDAERARTTVVVFQEASVGGLVAPLPGLLDQQGARARYRSIEIEEYIKGNFNALEQGTRFIQSLRI

SEQ ID NO: 31 - DNA, 639 bp, Zea mays
agtataaagttggacatgttcacagcaggcacggacacatcgtcgatcatcgtggagtgggcgatggccgaaatgctcaagaacccggccgtcatggcgcgcgcgcaggaggagctggaccacgtgttgggccgcggccggcgcctggaggagtcggacctgcccagcctcccctacctgcaggctgtgtgcaaggaggccctgcggctgcacccgtccacgccgctcagcctcccgcacttctccttcgacgcctgcgacgtcgacggctaccgcgtcccggccaacacccggctgctcgtcaacgtctgggccatcggccgggacccggccacgtgggaggcgcccctcgagttccggcccgagcggttcctgccgggggccgcggcgaaggtcgacccgctcggcaactacttcgagctcatccccttcggcgccggccggaggatctgcgccgggaagctggcgggcatggtgttcgtgcagtacttcctgggcactctgctgcacgcgttcgactggcgccttcccgacggcgaggagctggacatgcgcgagacgtttgggctcacggtgcctaaggccgtaccgctccgcgccatcgtcacgccgcggctcctgccagaagcctacgcctga

SEQ ID NO: 32 - protein, 212 aa, Zea mays
SIKLDMFTAGTDTSSIIVEWAMAEMLKNPAVMARAQEELDHVLGRGRRLEESDLPSLPYLQAVCKEALRLHPSTPLSLPHFSFDACDVDGYRVPANTRLLVNVWAIGRDPATWEAPLEFRPERFLPGAAAKVDPLGNYFELIPFGAGRRICAGKLAGMVFVQYFLGTLLHAFDWRLPDGEELDMRETFGLTVPKAVPLRAIVTPRLLPEAYA

SEQ ID NO: 33 - DNA, 819 bp, Zea mays
atgcacaggtcgcgcccaccatcagtagcggtcgccgccatgcagagactcgtgcgcgtcctcgtggtgctgggcgtggccgccgcggcgtcggcgcagggcccgacggcggcgccaacgacgcccacgccggcaacccccgcggcgcccgcgcccgcgacggcgtccagcaacatcacgggcgtgctggccaaggccgggcagttcaacaccttcatccggctgctcaagtccacgggcgtggcgtcgcagatcgacaaccaggtcgccaacggcgggaacggggtcacggtgttcgcgcccacggacaacgcgttccagtcgctgccctcgggcacgctcaactcgctgtcggaccaggacaagaacgcgctggtgcagtaccacgtggtgtccaccgccatccccatgtcgcagttcgacaccgtcagcaacccgctccgcacgcaggccggcagcgcctcgccgggggagttcccactcaacgtcacctcctccgagggccagcaggtcaacgtcaccacgggcgtcgtcaccgccaccgtcgacaactccctctactcgggcgacagcctcgtcgtctaccaggtcaacaaggtgctgctccccatgaagctcttcggcgccgcggaggcgcccgcgcccgcgccgctcgcgccggccaagaagaagggcaagacgccggcggccgtcgccgactcgcccgacgcggcggaggcgtccccggacgccacgaccacgtcgctcgcgcccgcgaggctgacgcggggtggcctcgccacggctcttgcgctcgccggcgtttggtgggggctgtag

SEQ ID NO: 34 - protein, 272 aa, Zea mays
MHRSRPPSVAVAAMQRLVRVLVVLGVAAAASAQGPTAAPTTPTPATPAAPAPATASSNITGVLAKAGQFNTFIRLLKSTGVASQIDNQVANGGNGVTVFAPTDNAFQSLPSGTLNSLSDQDKNALVQYHVVSTAIPMSQFDTVSNPLRTQAGSASPGEFPLNVTSSEGQQVNVTTGVVTATVDNSLYSGDSLVVYQVNKVLLPMKLFGAAEAPAPAPLAPAKKKGKTPAAVADSPDAAEASPDATTTSLAPARLTRGGLATALALAGVWWGL

SEQ ID NO: 35 - DNA, 1229 bp, Zea mays
ggacaggcagccaaatgccccaccacagcgtagcccctcctcactgactcacctgcaaaaaccacttgcaaaccacacaaaccgaaaccgccagctcccctgcctccatttttagcaacttttcccttcaatctcccgtcgcagtcacccttcttgcacccccgcgcagcttccgacacctccgaccttctctggcggcgccccgccgttggacgctcatggagaagagccgtccgggcgccgcgccgacaccatcgccagaggaggaggtggcggcggagggccacgcgcacggtgacgacgcgacggggcagaaggagcaggcgacgccagtggtgctcaagaagggcccgtggacggcagcggaggatgccatgctcatggaccacgtccggcaccacggcgaggggaactggaacgcagtgcagaggatgacaggcctgctgcgctgcggcaagagctgccgcctgcgctggaccaaccacctccgccccaacctcaagcgcggcagcttctcgcagcaggaggaggacctcatcgtcgcgctccacgagatcctggggaacaggtggtcgcagatcgcgtcgcacttgccggggcggacggacaacgagatcaagaacttctggaacacgtgcctcaagaagaagctccggcagcgcggcatcgacccggccacgcacaagccagtcgccgcggcggaggcgagcgcggcgctgccggacgctcgagaccacgaccgtgagcccggaggagccggcgccggcgccgacgccgacggcctggcgcagcagagcaagcagccggcggcggccgtgttcgacccgttccctgtggtcgacttcggcttcgacctgagcggcggcggcggcgtggcggcattgtacggcggcccgtacgacgccgccgccggcaaggcgtcggcggacgacggcgggttcgtggccgactacagcagcgtgctggacgtgtcggagaacctgggatacggggagagctccagcaacagcagcaactgggggaacggcgcggagatgggcaatgccgccgccgccgtgctcgacggcgaggtgctgcactgggccaagccggagccgtacacggagctggagcagcggagcgcggggcaagccgccgcggacgacgacgcgctgcatcataggttcttgctgccctgcggccaggagcagagcctggcgcatctcgacttcggcttggaatacttctga

SEQ ID NO: 36 - protein, 408 aa, Zea mays
  VARIANT 15: Xaa = Any Amino Acid
TGSQMPHHSVAPPHXLTCKNHLQTTQTETASSPASIFSNFSLQSPVAVTLLAPPRSFRHLRPSLAAPRRWTLMEKSRPGAAPTPSPEEEVAAEGHAHGDDATGQKEQATPVVLKKGPWTAAEDAMLMDHVRHHGEGNWNAVQRMTGLLRCGKSCRLRWTNHLRPNLKRGSFSQQEEDLIVALHEILGNRWSQIASHLPGRTDNEIKNFWNTCLKKKLRQRGIDPATHKPVAAAEASAALPDARDHDREPGGAGAGADADGLAQQSKQPAAAVFDPFPVVDFGFDLSGGGGVAALYGGPYDAAAGKASADDGGFVADYSSVLDVSENLGYGESSSNSSNWGNGAEMGNAAAAVLDGEVLHWAKPEPYTELEQRSAGQAAADDDALHHRFLLPCGQEQSLAHLDFGLEYF

SEQ ID NO: 37 - DNA, 1179 bp, Zea mays
atggcgacgcagcggttcacggcggcgctggtggcctgcctcctcctgctcctggcgctgccggcgcgcgggcgcaacatcacggccatcctcgccgggtacaaggagtacaagctatacaaccagtacctgtcggagacgaaggtgtgcgacgagatcaactcgcggcagtcgacgtcgatgtccgtcctggtgctgtccaacgacgccatgacgacgctggcctccgacgccggcgactcgctccccgccatcaagaacgcgctgcgcctccactcggtgctcgactactacgaccgcaagaaggtgaagaagtacggcgacgagagcgccgccacgctgtaccaggccacgggcgacgccgccagcaccacggggaacgtcaaggtggtggaccaggaggacaagaactacggcttctcggccgccacgccgggcgccaggatctgcaccgtcaccaaggaggtggagacgcaccctttcaagttcgccatcctcgaggtcacggcgcccatcgagttcgacggcctcttcgacaccccctccaccgacaacctcacccgcctcctggagcgcgccggctgcaaggtcttcgcgtcgctggccgcctccacgggcgtgctcaagacgtacgaggccgccatggacaagggcctcaccctgttcgccgtcaacgacgacgccttccaggccaaggacgcgcccgacgtcaaggccatgtccaaggccaacctcaccaagctcctccagtaccacgccctgccttcctacaacaccaagacctcgctcaagtccgtcaagggcccgctccgcacgctggccgccaaggccgacgtcacggtggtcgccaagggcgacgacgtctcgctcgacaccggcaagagcaggtcccgcgtcgcgtccaccgtcgtcgacagcgtcccgttctgcctgctcaccatggacaccctcctggtgccgccggagctctacgtcggcgccccggaggcggcaccggcgccggcgccagcggacgcgccacaggggtccccgcccgcggcggacgccccgtcggtggccgcggaccacgccgaccacaagtccaagaagccgtcggcgtcgtccgccgtcgcgtggcgaccggccggcgcgctcgccgcggtggccgtgtgctccgtcgtgctggcctccctcttgtga

SEQ ID NO: 38 - protein, 392 aa, Zea mays
MATQRFTAALVACLLLLLALPARGRNITAILAGYKEYKLYNQYLSETKVCDEINSRQSTSMSVLVLSNDAMTTLASDAGDSLPAIKNALRLHSVLDYYDRKKVKKYGDESAATLYQATGDAASTTGNVKVVDQEDKNYGFSAATPGARICTVTKEVETHPFKFAILEVTAPIEFDGLFDTPSTDNLTRLLERAGCKVFASLAASTGVLKTYEAAMDKGLTLFAVNDDAFQAKDAPDVKAMSKANLTKLLQYHALPSYNTKTSLKSVKGPLRTLAAKADVTVVAKGDDVSLDTGKSRSRVASTVVDSVPFCLLTMDTLLVPPELYVGAPEAAPAPAPADAPQGSPPAADAPSVAADHADHKSKKPSASSAVAWRPAGALAAVAVCSVVLASLL

SEQ ID NO: 39 - DNA, 897 bp, Zea mays
atgtccagccccacgcacgcccgcaaggccatccacctggcctccctgcgagccaggctcgcgcagcagggcaaggccggcgtggcgctgcgcctgctcctcgccgccgcgctcgccggcttcctcctcgtcttcgccgcgcgcaccctggtcacgtcgcctgtcccggcatcgccctcgtactcatactcgtcggagccgcagccgcatccgctgccgctgcccgtggcggaggcgctggtgcactacgccacgtccaacgcgacgccgcagcagacggcggaggagatcggggtggcgctgcgcgtgctgcagcggcgcgcgccctgcaacttcctggtgttcggtctgggcctcgacagccccatgtgggcggcgctgaaccacggggggcggaccgtgttcctggaggaggacgcggcgtggatcggcagcgtgcggggcaggcacccggcgctggagtcccaccacgtggcctacgacacggcgctggccgacgccgacgcgctgctagggctccgcgcccacccggcctgcgtcgcgcagcccgacctcgcggcggccgccgccgcgtcctgccgcctcgcgctccggggcctcccgcccgtcttcgccggcctcgactgggacctcgtcatggtggacgcgcccacggggtggacgccccgggcgcccggccgcatgggcgccatctacaccgccggcatggcggcgcgcgcgcgcaggccaggggccggccccacccacgtcttcgtccacgacgtcgaccgccccgtcgaggacgccttctccagggcgttcctgtgcgagggctacctcgccgaacaggtcggacggatcaggcacttcgtcatcccgtcacaccgcgacaaggacggcacgccattctgcccttga

SEQ ID NO: 40 - protein, 298 aa, Zea mays
MSSPTHARKAIHLASLRARLAQQGKAGVALRLLLAAALAGFLLVFAARTLVTSPVPASPSYSYSSEPQPHPLPLPVAEALVHYATSNATPQQTAEEIGVALRVLQRRAPCNFLVFGLGLDSPMWAALNHGGRTVFLEEDAAWIGSVRGRHPALESHHVAYDTALADADALLGLRAHPACVAQPDLAAAAAASCRLALRGLPPVFAGLDWDLVMVDAPTGWTPRAPGRMGAIYTAGMAARARRPGAGPTHVFVHDVDRPVEDAFSRAFLCEGYLAEQVGRIRHFVIPSHRDKDGTPFCP

SEQ ID NO: 41 - DNA, 1002 bp, Zea mays
atgatcagcacagcgcacagccggcagcagcaccatgccttcgagaagagccctggcaacagccacatgaagagcatcgacaggaagctgcagcaggccatgagccaggcggccagcaagtacatgcagaggatctaccctctaggcatgcagaggagcagctccagcctcacattgtcgtcgctctcgctgtcgcagaactccaacgactcctccatcagcagctccaactccagctgggagcccaaggtgccgctgctctacggcggcaccttcagcccatggggcgacgtcatggtgtctcgggagatgaggcgggaggacgatgacaaggtcagtgaccatgacgtcgaaggaggcgaggaggacttggactgcagtgagccggggagcctgcgtaggtgcagctggatcaccaagaacagtgacgaggcgtacgtccagttccacgacgagtgctggggcgtccctgtgtacagcgacaaccggctgttcgagcttctgtcgctgtcagggatgctgatcgaccacaactggacggagatactgaagcggcgggacatgtacagggaggcgttcgccgacttcgaccccagcgcggtggcgcggatggaggaggaggacgtggcggagatcagcggcgacagggagctgaggatcgccgagtgcagggtccggtgcatcgtggagaacgccaggtgcatccagagggtggccagggagttcggctccttcagcggctacatgtggggccacgtgaaccaccggccggtggtgggcaagtaccgccaccacaagtacatcccgttccggacgcccaagtcggaggcggtgagcaaggacctcgtccgccggggcttccgcctcgtcggccccgtcatcgtctactctttcatgcaggccgccggcatggccatcgaccacctcgtcgactgcttccgcttccacgactgcgtccgcctcgccgagcgctcctggggcatcaccaacgtcgccgcgtag

SEQ ID NO: 42 - protein, 333 aa, Zea mays
MISTAHSRQQHHAFEKSPGNSHMKSIDRKLQQAMSQAASKYMQRIYPLGMQRSSSSLTLSSLSLSQNSNDSSISSSNSSWEPKVPLLYGGTFSPWGDVMVSREMRREDDDKVSDHDVEGGEEDLDCSEPGSLRRCSWITKNSDEAYVQFHDECWGVPVYSDNRLFELLSLSGMLIDHNWTEILKRRDMYREAFADFDPSAVARMEEEDVAEISGDRELRIAECRVRCIVENARCIQRVAREFGSFSGYMWGHVNHRPVVGKYRHHKYIPFRTPKSEAVSKDLVRRGFRLVGPVIVYSFMQAAGMAIDHLVDCFRFHDCVRLAERSWGITNVAA

SEQ ID NO: 43 - DNA, 1212 bp, Zea mays
atggccatggccacggccggcgccgtcatcgcggcatgcatcctggcgctgctggccccgccgccggcgcgcgcggcgggcggcgggcggtgcgcgggtgagtccttctccgcgaaccgcgcctacgcggcgtgcaacgacctgccccgcctcggcgcgtccatgcactggacctacgaccgcgcgtcgggcgacctccacgtcgcgttcgtcgccgcgccggccgcgccgggcggctgggtggcgtgggcgctcaacccgtcgggcgacggcatggcgggcgcgcaagcgctcgtggcggggcccttccccgacggcggcggcacgtgggccgtgcggacgtacaacgtgtccgggtacgcgctcggggagcccgggcccatcgcgttcccggcgtcggacctcgccgccgagctcggcgccgacggccgcgtcagggtcttcgggacgctcggcctcggcgccgccgccgtaggcggcgggggcgtgctgctgaaccaggtgtggcaggtcggcgccgccgtctccagcggcggcgtcccggcgccgcacgccatgggggcggacaacctcgccgccaaggccaagctggacctgctgagggcgaccaccgtagccgccggagccgacagcgccaccaggaagcgcaatatccatggagtcctgaacgccgtgagctggggcctgctgctgcccatgggcgccatcttcgcgaggtacctcaagacgttccgggcggcggacccggcgtggttctacctccacgtcacctgccagctgatcggctacggcgtcggcgtctccggctgggccaccggcatgaagctcggcaaggagtccaggggcgtcacctacaccgaccaccgcaacatcggcatcgcagtcttcgctctcggcacccttcaagttctggcgctgttcctgcggccgaagaaggagcacaagttccgcgtgtactggaacacgtaccaccactcggtggggtacgccgtcatcgtgctgggcgtcgtgaacatcttcaagggcatgagcatcctgggcgtggagcagcggtggaggacagcctacatcgccgccgtctgcgtgctgctcgtcgccgccgcggcgctggaggccgtcacgtggggcgtcgtcctcaggcggcgcaaggccgacggcaagaccttcagcagcgcacccaacggccacctgccgcattccgtctccgtgtga

SEQ ID NO: 44 - protein, 403 aa, Zea mays
MAMATAGAVIAACILALLAPPPARAAGGGRCAGESFSANRAYAACNDLPRLGASMHWTYDRASGDLHVAFVAAPAAPGGWVAWALNPSGDGMAGAQALVAGPFPDGGGTWAVRTYNVSGYALGEPGPIAFPASDLAAELGADGRVRVFGTLGLGAAAVGGGGVLLNQVWQVGAAVSSGGVPAPHAMGADNLAAKAKLDLLRATTVAAGADSATRKRNIHGVLNAVSWGLLLPMGAIFARYLKTFRAADPAWFYLHVTCQLIGYGVGVSGWATGMKLGKESRGVTYTDHRNIGIAVFALGTLQVLALFLRPKKEHKFRVYWNTYHHSVGYAVIVLGVVNIFKGMSILGVEQRWRTAYIAAVCVLLVAAAALEAVTWGVVLRRRKADGKTFSSAPNGHLPHSVSV

SEQ ID NO: 45 - DNA, 1062 bp, Zea mays
atgttccagcagtgcccgatcgagtccctgcctgcctgcctgcccttttctatgtgctggggatgcagaagggacaggagtgggcgaggatatatgccgttgtgccgtgctgtttcggtggcggcgctggaccatcccccgcccgccgctgccgccgcggtgcccaaggaggaggtgtgggaggtccggcccggcgggatgctggtgcagaagcggagccccgacgcggacccgccccccggcggcgcgcccgtgcccaccatccgcgtcaaggtcaagttcaacggcgtctaccacgagatctacatcaactcccaggcatccttcggcgagctcaagaagctgctgtcggagaagacgggcctgcacccggacgaccagaaggtggtgtacaaggacaaggagagggactccaaggcgttcctggacatggccggcgtcaaggaccgctccaagatggtcatgctcgaggaccccgccgccaaggccaagcgcctcctcgaggagcgccggaccggcaaggccgagcgcgccgccaaggccatcgcccgcgccgccctcgacgtcgacaagctcgcaaccaaggtgtcggcgctggagacgatcgtgagcaagggcggcaaggtcgtggacgcggacgtggtgacgctgaccgaggcgctgatgaacgagctggtgaagctggactccgtcgccgccgaaggggaggtgaaggcggcgcggcgggcgcaggagaagcgggtgcagaagtacgtggagacgctggacgccatccgcgccaagaacaaggcggcggcggcggcggcgccggccaaggcccgcagcggcagcaacaaggcgcggccgccgcgcccgcccccggcttcggcgcacgcgcatcagagccagcagcagcgccggcagttccagccgccggcgccggtgtcgcagacccagacggcgagctgggagacgttcgacctcctgtcgtcagtgccgtcgacgtcggcggcccccgtgacgaccatggcccccgcgaccagcaccacgccgtccccgcgcttcgactgggagctcttctag

SEQ ID NO: 46 - protein, 353 aa, Zea mays
MFQQCPIESLPACLPFSMCWGCRRDRSGRGYMPLCRAVSVAALDHPPPAAAAAVPKEEVWEVRPGGMLVQKRSPDADPPPGGAPVPTIRVKVKFNGVYHEIYINSQASFGELKKLLSEKTGLHPDDQKVVYKDKERDSKAFLDMAGVKDRSKMVMLEDPAAKAKRLLEERRTGKAERAAKAIARAALDVDKLATKVSALETIVSKGGKVVDADVVTLTEALMNELVKLDSVAAEGEVKAARRAQEKRVQKYVETLDAIRAKNKAAAAAAPAKARSGSNKARPPRPPPASAHAHQSQQQRRQFQPPAPVSQTQTASWETFDLLSSVPSTSAAPVTTMAPATSTTPSPRFDWELF

SEQ ID NO: 47 - DNA, 486 bp, Zea mays
atgaccttcccgctggtttgctactgcaacgcggtgccgcgccccgtggccgcgctgttcaagaccatccacgccgcggcgctggtggtcgtgctggtcctctgcttcctgggcctctacgagttcccctacgaccccgaggaccacgcgccggtgatcaacgggcgggcccgcggcgggcgggacgcccctgggccggaggcggtgaagcggcacctcccgctcgtcgagttcctggagctgatggtggtggctccgtcgccgtcgtcgggggcggaggcggctccgacgtgccgggtgtgcctggagaggctggaggcggcggacggggtgcggcggctgggaaactgcgcccacgcgttccacgcgcgctgcatcgaccgctggatcgacctgggcgaggtgacgtgcccgctgtgccgctcccacctgctgccgcgccggcgcgccggcctgcttggcatggcacggcttggcgacggctag

SEQ ID NO: 48 - protein, 161 aa, Zea mays
MTFPLVCYCNAVPRPVAALFKTIHAAALVVVLVLCFLGLYEFPYDPEDHAPVINGRARGGRDAPGPEAVKRHLPLVEFLELMVVAPSPSSGAEAAPTCRVCLERLEAADGVRRLGNCAHAFHARCIDRWIDLGEVTCPLCRSHLLPRRRAGLLGMARLGDG

SEQ ID NO: 49 - DNA, 1257 bp, Zea mays
atgagcatctcggtgaacgggcagtcgtgcgtgccgccggggttccgcttccaccccacggaggaggagctgctcaactactacctccgcaagaaggtggcctcccaggagatcgacctcgacgtcatccgcgacgtcgacctcaacaagctcgagccatgggacatccaagagaaatgcaagatcgggtcgggtccccagaacgactggtacttcttcagccacaaggacaagaagtacccgacggggacgcgcaccaaccgcgccacggccgccgggttctggaaggccaccggccgcgacaaggccatctacaacgccgtcaagcgcatcggcatgcgcaagacgctcgtcttctacaagggccgcgcgccgcacggccagaagtccgactggatcatgcacgagtaccgcctcgacgaccccgctgctgctgctgctgctggatccggtgatgccgtggccaacgacgacgcagccgccacggctgctgctgctgccgccgcgtcgtcggacggcgggcaggaggacggctgggtggtgtgcagggtgttcaagaagaagcaccaccacaaggagtcaggtgggggcgggggcaacaagcacggcagcagtaacagcgagcatgggcacggcggcgccggcaaggcatcggctgcggctgcggctgcggcgcaccagcaccagcaccatggaggcctgcagtactcctccagcgacgaggcgctggaccagatcctgcagtacatgggcaggtcgtgcaagcaggagcacgagctggtgtcgccggcgccggcgccgccgggacgggcggcggcgtccaggtacctccggcccatcgagaccgttctgggcgggcacgcgttcatgaagcttcccgcgctcgagagcccgtccgcggccgcgtccgcatcgctgacacagccggcgcagcacgacgagctctaccgcgccgccgggaacgggatcacggactgggccatgatggaccggctggtggcgtcgcacctgaacgggcagcaggcgcccgccgcggcggaccagctcggcggcggctgcggcttcgacgcggacgccggcgccgaagacgcggacgccggcctcgccttctactccgccgccgccagccggctgctcggctccggcggcggcgccggcagcgacgacgacctgtggagcttcacgcggtcgtcggtttcgtcaacggcggcggcggcggccacgtccacggagcggctcagccacgtgtcactgtag

SEQ ID NO: 50 - protein, 418 aa, Zea mays
MSISVNGQSCVPPGFRFHPTEEELLNYYLRKKVASQEIDLDVIRDVDLNKLEPWDIQEKCKIGSGPQNDWYFFSHKDKKYPTGTRTNRATAAGFWKATGRDKAIYNAVKRIGMRKTLVFYKGRAPHGQKSDWIMHEYRLDDPAAAAAAGSGDAVANDDAAATAAAAAAASSDGGQEDGWVVCRVFKKKHHHKESGGGGGNKHGSSNSEHGHGGAGKASAAAAAAAHQHQHHGGLQYSSSDEALDQILQYMGRSCKQEHELVSPAPAPPGRAAASRYLRPIETVLGGHAFMKLPALESPSAAASASLTQPAQHDELYRAAGNGITDWAMMDRLVASHLNGQQAPAAADQLGGGCGFDADAGAEDADAGLAFYSAAASRLLGSGGGAGSDDDLWSFTRSSVSSTAAAAATSTERLSHVSL

SEQ ID NO: 51 - DNA, 1182 bp, Zea mays
atgaaggtcctcgtcctcgccgtgctggcgctcgtcgccgccgcctccgccgctggtcagggcgaggaggggggcgggccgccgctgccgttcgcgttgggcgcggcgccggcgggctgcgacgtcgcgcagggcgagtgggtgcgcgacgacgacgcccgcccatggtaccaggaatgggagtgcccctacatccagccgcagctgacgtgccaggcgcacggccgccccgacaaggcgtaccagagctggcgctggcagccgcggggctgctcgctgcccagcttcaacgcgacgctgatgctggagatgctgcgggggaagcggatgctgttcgtgggtgactcgctgaaccgggggcagtacgtgtccctcctctgcctcctgcaccgggccatccccgacggcgccaagtcgttcgagacggtggactcgctgagcgtcttccgggcgaagaactacgacgccaccatcgagttctactgggcgccgatgctggccgagtccaactccgacgacgccgtggtgcactccgccgacgaccgcctcatccgcggcgcgcccatggacaggcactacagcttctggaagggcgccgacgtcctcgtcttcaactcctacctctggtgggtcgccggggacaagatccagatcctgaggggcgccgacaacgacccgagcaaggacatcgtggagatgaagtcggaggaggcctaccggctggtgctgcaccaggtggtccggtggctggagcgcaacgtggaccccggcaagtcgcgggtgttcttcgtcaccgcttcgccgacgcacacggacggcagggcgtggggcgacgacgacgcggagggcagcggcaactgctacaaccagacgtcgccgatcagcgccgcctcgtcctaccgtggcggcacgagccgggagatgctgcgcgcgacggaggaggtgctggccacgtcgcgggtgcccgtcgggctggtcaacatcacgcggctgtccgagtaccgccgggacgcgcacacgcagacctacaagaagcagtgggtggagccgacggccgagcagcgcgccgaccccaggagctacgccgactgcacgcactggtgcctccccggcgtgccggacacgtggaacgagctgctctactggaagctcttcttccccagcaacgatcaggtcctctga

SEQ ID NO: 52 - protein, 393 aa, Zea mays
MKVLVLAVLALVAAASAAGQGEEGGGPPLPFALGAAPAGCDVAQGEWVRDDDARPWYQEWECPYIQPQLTCQAHGRPDKAYQSWRWQPRGCSLPSFNATLMLEMLRGKRMLFVGDSLNRGQYVSLLCLLHRAIPDGAKSFETVDSLSVFRAKNYDATIEFYWAPMLAESNSDDAVVHSADDRLIRGAPMDRHYSFWKGADVLVFNSYLWWVAGDKIQILRGADNDPSKDIVEMKSEEAYRLVLHQVVRWLERNVDPGKSRVFFVTASPTHTDGRAWGDDDAEGSGNCYNQTSPISAASSYRGGTSREMLRATEEVLATSRVPVGLVNITRLSEYRRDAHTQTYKKQWVEPTAEQRADPRSYADCTHWCLPGVPDTWNELLYWKLFFPSNDQVL

SEQ ID NO: 53 - DNA, 348 bp, Zea mays
atgaagggcctcttgttgctcgtcatcgccctggtcgcgtccgctgcatgcctcgtgaccgtccgcggcgcgggcgagtgcggggcgacgccgccggacaggatggcgctgaagctggcgccgtgcgcgtccgcggcgcagaaccccagctcggcgccgtccaacggctgctgcacggcggtgcacaccatcgggaagcagagcccccagtgcctctgcgccgtcatgctgtccaagacggccaagaagtccgggatcaagcccgaggtggccatcaccatccccaagcgctgcaacctcgtcgaccgccccgtcggctacaagtgcggagattacactctgccatga

SEQ ID NO: 54 - protein, 115 aa, Zea mays
MKGLLLLVIALVASAACLVTVRGAGECGATPPDRMALKLAPCASAAQNPSSAPSNGCCTAVHTIGKQSPQCLCAVMLSKTAKKSGIKPEVAITIPKRCNLVDRPVGYKCGDYTLP

SEQ ID NO: 55 - DNA, 1749 bp, Zea mays
atgggcgcgcgtcgtggtctccggcgaggccaagccgccgccgccgccttctccgcatgtcccttcctcgccctcgccgtcgtcctcctcgccttgccggagctcgcagccggcgacacccactactacacgttcaacgtgcaaatgaccaacgtgacacggctgtgcgtgactaagagcatcccgacggtgaacggggagttcccggggccgaagctggtcgtgcgggaaggcgaccgcctcgtggtcaaggttcacaaccacatcaactacaatgtctcgttccactggcacggcgtccggcagctgcgcaacgggtgggcggacgggccgtcgtacatcacgcagtgcccgatccagggcgggcagagctacgtgtacgacttcaccgtcacggggcagcgcggcacgctgtggtggcacgcgcacttctcctggctgcgcgtgcacctctacggcccgctcgtcatcctccccaagcgcggcgagggctacccgttcccgcgcccctacaaggaggtgcccatcctcttcggcgaatggttcaacgcggacacggaggccgtcatcaaccaggccctgcaaacaggcgccggcccaaacgtctccgatgcctacaccttcaatgggcttccaggcccgacatataactgctcgtctaaagacacgtacaagctgaaggtgaagcccgggaggacgtacatgctccggctcatcaactccgccctcaacgacgagctcttcttcggcatcgccaaccacacgctcaccgtcgtcgaggcggacgccagctacgtcaagccattcaccgtcagcacgctcgtcatttcaccggggcagaccatgaacgtgctcctcacgacggcccccagccccgcctccccggcctacgccatggcgatcgcgccctacaccaacacgcagggcacgttcgacaacaccaccgccgcggccgtcctcgagtacgccccgacgacgaccaggaacaacaccctgcctcccctaccggcyctgccgctgtacaacgacaccggcgcggtgtccaacttctcgcgcaatttccgcagcctgaacagcgcgcgctacccggcgcgcgtgccggtggcggtggaccggcacctgctgttcaccgtggggctcggcacggacccgtgcccgtacaccaaccagacgtgccagggccccaacggcaccaagttcgcggcgtccgtcaacaacaactccttcttccgcccccggaccgcgctcctcgaggcgcactaccggcgccgctacgccggcgtgctcctggccgacttccccacggccccgccgcacccgttcaactacacgggcaccccgcccaacaacacgttcgtgcagcacggcacgcgggtggtgccgctccgcttcaacgcctccgtggagctggtgctgcagggcaccagcatccagggcgccgagagccacccgctgcacctgcacggctacaacttcttcgtggtcggccaagggttcggcaacttcgacccggtgaacgacccgcccgggtacaacctcgccgaccccgtagagcgcaacaccatcagcgtgcccaccgccggctgggtcgccgtccggttcctygccgacaacccgggcgtgtggctgatgcattgccacttcgacgtgcacttgagctggggcctgtccatggcgtggcttgtcaacgacggcccgctgccgaacgagaagatgttgcccccgccatccgacctcccaaaatgctga

SEQ ID NO: 56 - protein, 582 aa, Zea mays
  VARIANT 535: Xaa = Any Amino Acid
MGARRGLRRGQAAAAAFSACPFLALAVVLLALPELAAGDTHYYTFNVQMTNVTRLCVTKSIPTVNGEFPGPKLVVREGDRLVVKVHNHINYNVSFHWHGVRQLRNGWADGPSYITQCPIQGGQSYVYDFTVTGQRGTLWWHAHFSWLRVHLYGPLVILPKRGEGYPFPRPYKEVPILFGEWFNADTEAVINQALQTGAGPNVSDAYTFNGLPGPTYNCSSKDTYKLKVKPGRTYMLRLINSALNDELFFGIANHTLTVVEADASYVKPFTVSTLVISPGQTMNVLLTTAPSPASPAYAMAIAPYTNTQGTFDNTTAAAVLEYAPTTTRNNTLPPLPALPLYNDTGAVSNFSRNFRSLNSARYPARVPVAVDRHLLFTVGLGTDPCPYTNQTCQGPNGTKFAASVNNNSFFRPRTALLEAHYRRRYAGVLLADFPTAPPHPFNYTGTPPNNTFVQHGTRVVPLRFNASVELVLQGTSIQGAESHPLHLHGYNFFVVGQGFGNFDPVNDPPGYNLADPVERNTISVPTAGWVAVRFXADNPGVWLMHCHFDVHLSWGLSMAWLVNDGPLPNEKMLPPPSDLPKC

SEQ ID NO: 57 - DNA, 792 bp, Zea mays
atggagtccaaggcagcaattattcttgccgcggctgtactggccgtcctcttcgccccggcattgggtcagaagagcagcccgccggcgccggcgcccatgtcgctgccgccgaccccggcaccggcgccggcgccgcactacgtggacctcgcggagctcctgagcgtggcgggcccgttccacacgttcctcaactacctggagaagagcaacgtgatcgagaccttccaggggcaggccaacaacaccaaggtgggcatcaccgtgttcgtgcccaaggactcggcgttctcggcgctgaagcagtccaccttctccaacctcaccgccgaccagctgaagacgctgctgctgtaccacgcgttgcccaagttctactccctggccgagttcaagaacctgagctcgctcaacccggtgaacaccttcgccgggtcgccctacacgctcaacctcaccgacgacatgggcagcatctacgtgcagtccatgtggtccaggcccaagatcgccagcagcgtgtacgccaccaggcccgtcgccgtctacgcgctcaacaaggtgctcctgcccatgcagctcttcagcaaggacccgccgctggcgccggtgcccgcgcccgccccggagcccggcgcgtccgacgcccccggcccggcggccggcaaggccggcgggctgagggcggcaagggtgactccaccagcgccgcgcgacacgggcgccgtcggcgttgccagttccttgctgctcgccgccgcagcaggctgcttgattctccagtggtga

SEQ ID NO: 58 - protein, 263 aa, Zea mays
MESKAAIILAAAVLAVLFAPALGQKSSPPAPAPMSLPPTPAPAPAPHYVDLAELLSVAGPFHTFLNYLEKSNVIETFQGQANNTKVGITVFVPKDSAFSALKQSTFSNLTADQLKTLLLYHALPKFYSLAEFKNLSSLNPVNTFAGSPYTLNLTDDMGSIYVQSMWSRPKIASSVYATRPVAVYALNKVLLPMQLFSKDPPLAPVPAPAPEPGASDAPGPAAGKAGGLRAARVTPPAPRDTGAVGVASSLLLAAAAGCLILQW

SEQ ID NO: 59 - DNA, 540 bp, Zea mays
atggccgctcctctatgctcttccgtttccgtgtctctcatgctgctactgctagtgctctcggcctcggcctcggcggcgtccgccgcggacgggaagctgatccacctccacttctacttccacgaggtcgacgccggcacgcccaacgccaccgtggtcaacgtcgccagcctgcacaagaacgcctcgacgttcggtgacctgaacgtgttcgacaacgcgctgcgggagggggcggacccggcgtcgcggctcatcggcagggcgcaggggatcggggtgcacgcgtcgctggacgaatccggcggcctcaccgccatcgactttgccttctccgactacggcgagtacagcggcagcacgctggcgacgacgggacacttcaccgtgtcagccccatcggagcgcagcatcgtcggcggcaccggcaagctccggttcgcgcgcgggtacctcaccagcaggctcctcagctccacggacacctccatcgtcgtcgtcttcgacatgtacttcaccctggcccactggcactga

SEQ ID NO: 60 - protein, 179 aa, Zea mays
MAAPLCSSVSVSLMLLLLVLSASASAASAADGKLIHLHFYFHEVDAGTPNATVVNVASLHKNASTFGDLNVFDNALREGADPASRLIGRAQGIGVHASLDESGGLTAIDFAFSDYGEYSGSTLATTGHFTVSAPSERSIVGGTGKLRFARGYLTSRLLSSTDTSIVVVFDMYFTLAHWH

SEQ ID NO: 61 - DNA, 906 bp, Zea mays
atgggacgccacgcggcctccggcggcggcgtgcagcagaagctgcgcaagggcctctggtcgcccgaggaagacgagaagctctacaaccacatcattcgctacggggtcgggtgctggagctccgtgcccaagctcgcagggctgcagagatgcggcaagagctgccggcttcggtggatcaactacctacgccccgacctgaagcggggcagcttctcgcagcaggaggaggacgcgatcgtcggcctccaccagatcctggggaacaggtggtcgcagatcgcgtcgcacttgccgggccggacggacaacgagatcaagaacttctggaacagctgcctcaagaagaagctgcgtcagcgcggcatcgacaccagcacccacaagcccgcggtctccgccagcgtgccggcggcatcggagcagccggtgtcgcaggaccgcaagccgttggccgcagccgccgctgatggcggctccgacatgaagcaccagcaggtgttcgacccgttcccgctgaccgacagcttcggcggcggcttcggcgccgcactgtacggccacacgggcggcaagcaggacgcggccgcgttcgtggactacagcagcgtgctggacgtgtcggagaacctgggctacggcggcgagagctccagcaacagcagcaactggaactgcgcgccggaggtgcacaacaatgcgctcgacggcgacgcgccgctgcactgggcctccgagagcaaggccacgcccttcgccggctacggcggcgaggagcaatcactcctcgggcacaggttctcggtgccctgccacggccagcaggagcagagccctccgcgttttgacttcgacatcggccggggcgccgtggtcggcgagttcagcctcgagttcttctga

SEQ ID NO: 62 - protein, 301 aa, Zea mays
MGRHAASGGGVQQKLRKGLWSPEEDEKLYNHIIRYGVGCWSSVPKLAGLQRCGKSCRLRWINYLRPDLKRGSFSQQEEDAIVGLHQILGNRWSQIASHLPGRTDNEIKNFWNSCLKKKLRQRGIDTSTHKPAVSASVPAASEQPVSQDRKPLAAAAADGGSDMKHQQVFDPFPLTDSFGGGFGAALYGHTGGKQDAAAFVDYSSVLDVSENLGYGGESSSNSSNWNCAPEVHNNALDGDAPLHWASESKATPFAGYGGEEQSLLGHRFSVPCHGQQEQSPPRFDFDIGRGAVVGEFSLEFF

SEQ ID NO: 63 - DNA, 318 bp, Zea mays
tacggcgcggcgtacccgcggcgggtgcaccaccgcgcggcgtcgagcgcgtcgtaccggcacgaccgggacttcatcggctgcctgcaggggttcgactcgtggtacagcgcgcggcaggagaacccgcacgacctcgtcggcgccgtcgtcggcgggcccaacggcgaggacgtcttcaacgaccaccgcggcgcgtacatgcagactgaggcctgcacgtacaacacggcgcccatggtcggggtcttctccaggctcatgcagctggaggggcagtcgccacgcccggcgccggcgccggcggaggatctttga

SEQ ID NO: 64 - protein, 105 aa, Zea mays
YGAAYPRRVHHRAASSASYRHDRDFIGCLQGFDSWYSARQENPHDLVGAVVGGPNGEDVFNDHRGAYMQTEACTYNTAPMVGVFSRLMQLEGQSPRPAPAPAEDL

SEQ ID NO: 65 - DNA, 1227 bp, Zea mays
atggcggtgctccactctccggtcggagtgaggagcatcgtgacctccctggtggctttcttcatcctagccagctccgtggtgttcctcctcctcgacagagaagccgggctccaagaagaaccggcgataagagccggcggcggcggcggcgacgaggagtgcagctggtctcgggggcgctgggtgtacgacaacgtgtcccggccgctgtacgacgggctcaagtgcgccttcatcttccccgaggtggcctgtgacaagtatggcaggaaggatgtcatgtaccagcactggagatggcagcctcatggtcatggatgcgacctcccaagattcgatgccatgaagctgcttgaagagctgaggaacaagagactggtgtttgtgggtgactcggtgaacaggaaccaatgggtctctctcgtgtgcatggtggaggcctcgatacctgacgacaggctcaagatgcgcatcttcaatggctcgctcatctccttcaaggcactggagtacaacgcgacgatagatttctactggtcgccgctgctggtggagtctaacagcgacaaccccatcatccaccgggtggagtaccggatcataagggcagacaggatcgagaagcacgccagcgtgtggagggacgccgacgtcatcgtcttcaactcttacctgtggtggaggaagcagaaggatgacatgaggatgaaggaagatggtgacgcaaagctagacgagatggaaatggcggatggtttcgagatagctatcaagaaactgacggaatggcttgcaaagaacattgacaagaacaagactaggatatttttcgcaggatcatcaccaacacattcctgggctagcaactggggcggacaagacaagaacaagtgcctgaacgaaacggagccgatcagctacagacccggcggcgggtacaaggctgcaaccacggactacagcctgatggccatggccaggtcctacttccggcggacgctggagccgagaggcatacgcgtccagatactcaacatcacggagctgtccgactaccgcaaggacgggcatcccacggtgttcaggaggcagttcgttcccctgaccaaggagcagatcgcggacccggccagctacgcggactgcacgcactggtgcctcccaggcgtccccgacgtctggaacgagttcctgtatggctacctcacgcagcagagcaaatga

SEQ ID NO: 66 - protein, 408 aa, Zea mays
MAVLHSPVGVRSIVTSLVAFFILASSVVFLLLDREAGLQEEPAIRAGGGGGDEECSWSRGRWVYDNVSRPLYDGLKCAFIFPEVACDKYGRKDVMYQHWRWQPHGHGCDLPRFDAMKLLEELRNKRLVFVGDSVNRNQWVSLVCMVEASIPDDRLKMRIFNGSLISFKALEYNATIDFYWSPLLVESNSDNPIIHRVEYRIIRADRIEKHASVWRDADVIVFNSYLWWRKQKDDMRMKEDGDAKLDEMEMADGFEIAIKKLTEWLAKNIDKNKTRIFFAGSSPTHSWASNWGGQDKNKCLNETEPISYRPGGGYKAATTDYSLMAMARSYFRRTLEPRGIRVQILNITELSDYRKDGHPTVFRRQFVPLTKEQIADPASYADCTHWCLPGVPDVWNEFLYGYLTQQSK

SEQ ID NO: 67 - DNA, 549 bp, Zea mays
atgatgacgctcctcaagacgtacaaccacaacgacaagcagcaccagttctcgcttcccaagaggaacttcgtcacctacgccgtctacgcgctcatcgccgtcgcgctcctctacctgttcgtcgacccggcagctccgcctactgcgggttcgggttcgactgcggcatcatctactaccaagccatcatcactggcggcagcggcgaggccaccctggatacagcagcagcagcagccgccgccgctgtcgtcgtcaatatcttccctacctccttctccttacgaagcatcatcatcgacgatgtcctccaatgatagtgcccagccgctgcggttcgcggcgctggacgtcacggcgctggccaacatgcggccggacggccacccgggcccgtacatgcgcaagaacccgttcgccggcggcggcggcaataacacgggagaccaccgcccggtgcagcacgactgcttgcactggtgcatgccagggccggtcgacaccttcaatcagatactgctccagaccatcctccgcgcgcgctag

SEQ ID NO: 68 - protein, 182 aa, Zea mays
MMTLLKTYNHNDKQHQFSLPKRNFVTYAVYALIAVALLYLFVDPAAPPTAGSGSTAASSTTKPSSLAAAARPPWIQQQQQPPPLSSSISSLPPSPYEASSSTMSSNDSAQPLRFAALDVTALANMRPDGHPGPYMRKNPFAGGGGNNTGDHRPVQHDCLHWCMPGPVDTFNQILLQTILRAR

SEQ ID NO: 69 - DNA, 1023 bp, Zea mays
atgtcagctggtttccagctcggtgtgatcgggtcacttgcactctctgtcgcatcctcagttgccattgtcatctgcaacaaagctctcatcagcacgcttggttttccgttcgccacaacattaacaagctggcatctgatggtgaccttctgcaccctccatgtggcacatcgcttgcatttcttcgagcccaaggcgattgatggacagacggtgatactctttgggttgctgaatggcacgtcaattggccttctcaacctgagcttaggattcaactccattggattctaccagatgacaaaattggcgatcatacctttcactgtgctattggagactatcttcttgaacaaaagattcagcgagagtatcaaactctctcttctggtcttacttcttggagtaggaattgcttcaattactgatctcaagctaaacatgcttggttccatcctttctggcctcgccattgccactacttgtgttggccaaattctcacaaatacaatacagaagaggttgaaggtctcctcaacgcagcttctgtaccaatctgcgccttaccaggcaggaattctgtttgcaactggcccttttgtggatcaacttcttactgaccggagtgtctttgcacacaaatactctgctccagttctgggtttcattgtcctatcttgcttgattgcggtgtctgtgaacttcagtacatttcttgtgatcggaacaacatccccagtgacataccaggtgcttggtcaccttaagacatgtctggttctatcatttggttacactctattacatgatcctttcactctaaggaacatattgggcattctaattgccatatttggtatggcactatactcctacttctctgtaagagagggcaagaagaagtcagcaaatgatgctctaccagtttcacagatggcagataaggaggctgaaccacttttggcaactaaagacaacaacgacaccaagaaagcaaatggtttatctcacgactgctga

SEQ ID NO: 70 - protein, 340 aa, Zea mays
MSAGFQLGVIGSLALSVASSVAIVICNKALISTLGFPFATTLTSWHLMVTFCTLHVAHRLHFFEPKAIDGQTVILFGLLNGTSIGLLNLSLGFNSIGFYQMTKLAIIPFTVLLETIFLNKRFSESIKLSLLVLLLGVGIASITDLKLNMLGSILSGLAIATTCVGQILTNTIQKRLKVSSTQLLYQSAPYQAGILFATGPFVDQLLTDRSVFAHKYSAPVLGFIVLSCLIAVSVNFSTFLVIGTTSPVTYQVLGHLKTCLVLSFGYTLLHDPFTLRNILGILIAIFGMALYSYFSVREGKKKSANDALPVSQMADKEAEPLLATKDNNDTKKANGLSHDC

SEQ ID NO: 71 - DNA, 822 bp, Zea mays
atggagagggcggccccagtgaggagttcccacacctccacggccggcctactcgcgtggcctcaacccgatggcgccgcgtcgcaggcaccacgtcggcctaaccagccgacggaggaattcaggaaggtggtgttcggggggcaggtcaccgaggaggccgacggtctcaacaagacgaagatgaggacgacggcctccgcacccaagtcgaaggagacaacagggatcggcatgtttaaggccgagagcgccgccgccgccgtcacaactgcatcccgtgatcgccaggctagccagatcactttttctcaggacgggaccattcctcccaggaagccaacttcagttgctggggtggcgaggcagcgcgaacttagccataccgttgagagttcgggggacggtaagatgaagcggcaggtgtccaatgcgaaatccaaggagctcagtggtcacaacatctttgctgatcatgaagatccgagtcccaacaggtcaagcagctctgctgctgctctggcacatgtgaaaaatgcaaatgtgagctccttctcctttggaaaggccgacatggacagcacagtgaaaacagcaaagaagaaagggtccagcaacaagtctactgatctgatgaatggcaaggccatctccgagagggattcagcgcctgcagggaaacagcctctgaaccgcgcgaagccgaaaggattgagtggtagtagcatttttgcagacgggaaggcctcaacaactggtgatcatgcaggccgtcggacccggcagccacctggcggcgacagcagcatcttgctgggctag

SEQ ID NO: 72 - protein, 273 aa, Zea mays
MERAAPVRSSHTSTAGLLAWPQPDGAASQAPRRPNQPTEEFRKVVFGGQVTEEADGLNKTKMRTTASAPKSKETTGIGMFKAESAAAAVTTASRDRQASQITFSQDGTIPPRKPTSVAGVARQRELSHTVESSGDGKMKRQVSNAKSKELSGHNIFADHEDPSPNRSSSSAAALAHVKNANVSSFSFGKADMDSTVKTAKKKGSSNKSTDLMNGKAISERDSAPAGKQPLNRAKPKGLSGSSIFADGKASTTGDHAGRRTRQPPGGDSSILLG

SEQ ID NO: 73 - DNA, 1227 bp, Zea mays; identical to SEQ ID NO: 65

SEQ ID NO: 74 - protein, 408 aa, Zea mays; identical to SEQ ID NO: 66

SEQ ID NO: 75 - DNA, 801 bp, Zea mays
atggcgccgcggctgctggcgtgcttcgggcgcggcgtcgcggcggcgccggacgacgcgactggcgagggccagctggaggcgccccccgctggcccggtgctggtggagctgttcgggtcgcaggggtgcggggcgtcgcccgaggcggacgccgtggcggcgcggctggcgcaggactccgggtccggggacggcgccgtcgtggtgctggcgttccacgtcgactactgggactaccgcgggtggaaggaccccttcgcgtccagcgcctggaccgtgcgccagaaggcctacgtggaggcgctccgcctcgacacgctcttcacgccgcaggtcgtcctgcagggccgcgcgcactgcgtcggcaccgaccaggacgcgctcgcgctggccgtccgcgacgccccgcgctaccccgcgcccgccatcaaggtcacgttccagcggccgagccccgcaacactgcaggcgtcgttcacgggcaccctgcgcagccgcgtggagggcccaggcggcgcgagcgtgctggtggcgctgtacgagagcgggctggtgaccgactgcgggcgcggcgagaacaagggcaagtcgctgctcaacgaccacgtggtgcgccgtctcgagaaggtggccgccgtgcgggagggcgcctcgccgaagaagaccgtgtcgggcaccgtccagttcccgctctgggacggctttcgcgccaccaagtgcggcctcgtgctcttcgtccagaacgccgcgctgcaggtgctcggcgtccagcacttcgacctgcctgacaacgtctga

SEQ ID NO: 76 - protein, 266 aa, Zea mays
MAPRLLACFGRGVAAAPDDATGEGQLEAPPAGPVLVELFGSQGCGASPEADAVAARLAQDSGSGDGAVVVLAFHVDYWDYRGWKDPFASSAWTVRQKAYVEALRLDTLFTPQVVLQGRAHCVGTDQDALALAVRDAPRYPAPAIKVTFQRPSPATLQASFTGTLRSRVEGPGGASVLVALYESGLVTDCGRGENKGKSLLNDHVVRRLEKVAAVREGASPKKTVSGTVQFPLWDGFRATKCGLVLFVQNAALQVLGVQHFDLPDNV

SEQ ID NO: 77 - DNA, 1418 bp, Zea mays
agcgagctggccggctaggccaggagaggagaggggagacacagacaacgagcgctcgctgggaagaggaagaggttcgtggggacgcagggatccagaggaagatgaggcggtgggtcttagccatcgccattcccattctcgccgctgcttcggcggcggcgctgttccttggggctgaggcccaggcggtccagcagggccaccagacagagaggatctcaggaagtgctggtgacgtgttggaagataaccctgttgggaggctcaaggtttacgtgtatgatctccccagtaaatacaacaagaagctggtgaagaaggatcctaggtgcctgaaccacatgtttgctgctgagatcttcatgcaccggttcctgttgtcaagtgctgtccgaacatttaatcctgaagaagcagattggttctacactcccgtatacgccacatgtgatctgactccttcgggtcttccccttcccttcaaatctccacgcatgatgcgcagcgcaattgagctgattgccacgaactggccttactggaacagatcagagggtgcagatcatttctttgtcacgccccatgactttggtgcttgctttcattatcaggaagagaaagcaatcggacggggaatccttcccttgcttcagcgtgctacactggttcagacctttggacagaagaaccatgtctgcctgaagggcgggtccatcacaatcccaccatttgcacctccccagaaaatgcaggctcaccttatccccttggacacccctcggtctatcttcgtgtacttccgtggtctgttctacgacaccagcaacgatcctgagggtggttactatgcgagaggtgctcgtgcatcagtctgggagaacttcaagaacaacccgctcttcgacatctcgactgatcacccaccgacttactacgaagacatgcagcgttcagtgttctgcctgtgccccttgggctgggctccatggagccccaggctggtggaagctgtggttttcggctgcatcccggtgatcatcgccgacgacattgtcctgccctttgcggacgccatcccgtgggaggagattggtgtgtttgtcgccgaggaggatgtcccgaagctggacagcatcctgacgtccatcccaacagatgttatactgaggaagcagcgtctcctcgcgaacccggccatgaagcaggccatgctgttcccccagcctgctcaggcgggagatgcattccaccagatcctaaacgggctcgcgcgcaagctcccacatggtgacaacgtcttcttgaagcccggggagagggtcctgaactggaccgccggaccgccaggcgacctgaagccttggtagcatctgcctgcctagaacctttttgggaaaaaagcaagaacgagaaca

SEQ ID NO: 78 - DNA, 1042 bp, Zea mays
gtggaccggcccgtggcgtacaaggaggtgctgacgacgtgggcgaaatgggtggaccgcaacatcgaccccaacaggacgaccgtcttcttcatgggcatgtctcccaaccacatcaccatttgtattgagcagcatggtgcattgagcaggcctgaggcttggggcaacaagggcgggatcaagtgcgccatggagacgctgccgatcgcgagcaaccgcagcgcggcgctggacgtgggcacggactggcgcctctacgcgggggcgcgggaggtgctgcccacgctgcgccgggtgcccgtccacttcgtcgacatcaccgcgctgtcggagctgcgcaaggacgcgcacacctcggtgcacacgctgcgccaggggaagctgctcaccccggagcagcaggccgaccccaagacctacgccgactgcatccactggtgcctcccgggcctgcccgacacctggaaccagttcctctacgcccgcatcgcatccagcccatggcccaacgacgcccaggcccagcagtagggaccctgcacctgctcctccttctatcttcctcattcgccgcgggccggcgcctcacgacacaaaagggaggcctgggctgcaacggcccgcccatcgacgagagctctggcgtttctgcttcaagctagctgatcagccaaaagggggcgaaagacggcgtttctgctcgccgtctttgttttctttccttttttttaaacgatttttctttctcttttcgttgcataaaaggaaactggtccgtgttgttcaccttcgattctttggtccaaacacaagtggatggtctggggtaaatgagggtgtgacgagcttagttgctcgctcatttggtttcttctcctaccaacgatgcctagggggaaagcaagagttgagcatgaagatgtgatgggggagaagcaaagctggggggagtacatgtaaagaagattttttgcgttgtatttttatatgctgctgcagtgcacccaaggttaagagaggtataaagagcatttgttct

SEQ ID NO: 79 - DNA, 1975 bp, Zea mays
cgccatacggctgcagcatcttcccctcaccctcctcattaccccgcgtctctccctcaaaactactcattgctctcaccgttccattgcccccgcggccccgccgtacgctcattcccggctagctcctcctccgcacggccatgatcttgagttcttggcattgatgacgttctagtaccgagcgagccagcccctctttaacccaccttaacaataaacacagcctgcccccaccggccacctcttcttcccccgtgcagctcgagctgattcggcgggctctgccccaacatccacccaccttcgtccaatcccgatccaagaccgtgccgtgatccggcagcagcttccgcgcggccatgggcacgggcgcggtggcggtggcggcgccggaccgggccaagcagcggcgggccggccacctgtggaagaaggcactgctccacttctccctctgcttcgtcatgggcttcttcacgggcttcgcgccttcctcctcctcctcctggaagtccgccgccgccaccccccagcaccacccgccgcaccaccgcctcgccgcctcccgcgtggccgtcgacgcgcgcgccaccctgtcgccgcccgcggaggccgccgatgcgctctccgccggcgccacggtggacttgggcgacgacgaggaggacgccgcccagcgccgcctcctgatcgtggtcaccaccacgcgcggggagcgccgccgccgccggggcgagctgctgcgcctcgcccacacgctgcgcctcgtgcgcccgcccgtcgtctgggtcgtcgtcgagcccgccgccgacgcgcccgccaccgctgaggtgctccgcggcaccggcgtcatgtacaggcacctcgccttcaagcccgaggacaacttcaccaccgccgacgccgaggctcacgtgcagcggaacgccgcgctcgcgcatgtcgagaagcaccgactcgccggcgtcctgcacttcgccgacgccgccggcgtctacgacgtcggcttcttcgaacagatccgccagatcgaggcgtttggtacatggcctgtggcaacaatgtcggcgggcgagaagaaagtggtagtggagggtccactgtgcagtgcctcaaaggtcgtcggttggttctcaagggacttcaacgacgggaccacccgttcagtgacgtataacacggaagctgacctgaatcctgctggtgccgctggtacacgagcccacacgatcgacgtctcaggttttgcgttcaatagctctattttgtgggatcctgagcggtggggacggccaacgtcattaccagacacttcacaggactcgatcaagttcgtgcaagaagtgctacttgaagaccgagctaagctgaaggggatcccctccgactgctcccagatcatggtgtggcagtacagcgtgcccagctcgcgatagagggcagccgagaggacgcacaagaggcgtcgcaacctcgcaggcaggggaagaactgcagggggttggatcggagtcgctgtaaatgtggtgggcgatggtaacggcaaggaaagcaagaaggctgattactaaaagggttctttttctctctctctcctttttgtgttccctttttctttcccctcagttttagttttcaggtttgggaggggggccatgaatgatgaactgtccgtgggagcaaaagaattgcgatagtatttattcagattcatttgtgattctttagcctggtcggttggtcctgttgtgtttgggttaaaaaaaatggcagtggcgtgaggaatggagaagtttttattgtgttatggcatgaaatcccagcaaggcagcagcaattaacatctggagaacataaaaatcatgtgcaaagggaaagaaagaaaaaaaaagagaagagactgaatccgcgctcaggtcttgttgtcatcgtccctggtgtttccttgcgggacagtgtttattggctttgg

SEQ ID NO: 80 - DNA, 1247 bp, Zea mays
atgaaggcaatggccgggccaaagctgctcgtcgtccacgcgtcgtcgaacaaggccctgaacgggatggcgcccacgtcgccggcgtcgcccggctggtcgcggtgcctgtggctggtggtgttcctggccttgttcacctgcgtgtccctcctgaccgtgctctccacggcgcgcgcctcggccggggcgccggcgtgccaggcggcgtcgctcacggccagcgctgccggcgccacggaggccggcctgccgcggcacgtgttcgacgcgctggtgcagtacgcggcggcggcagggaacttgtcgtcgagcatgccggagccggacgtgcgcgcgatcgcgtcggtgctccggcggcgcgcgccgtgcaacctgctggtgttcgggctgggcgcggagacgccgctgtggcgcgcgctcaaccacggcgggcgcacggtgttcctggacgagaacccgtactacgtggcccacctggagggtaagcacccggggctggaggcctacgacgtggcctacgccacggcggtgcgcgagctccccgacctcctcgacgccgcccgtgccgcgcgcgccgctgagtgccgccccgtccagaacctgctcttctccgagtgccgcctcgccatcaacgacctccccaaccagctctacgacgtcgcctgggacgtcatcctcgtcgacggcccgcgcgggttcatggaggggtcgccggggaggatgtcggcgatctactcggctgcggtgatggcgcggaccaagggcgcggagacggaggtgatggtgcacgactacgagcgggaggtggagcgcgcgtgcggccgggagttcctgtgtgacgagaaccgggtcacggcgaccagcacgccgtcgctcggccacttcctcgttcgcggcggcgccgccgccaaccgggaagccttctgcgggccgcccgccggcgccgcccagaaatcgaaaccgagctaagcgagtcgtagtcgttacttctccttcccgggcaatgttggcgatctctctttgacaggggaaagtaatgaactcgcggaattgactcaaggaagcataggtcagtggttcctcgtattcttttcgaacaaatcctgtattcctgtgggtggtggtggtccaatgatttctcccttcaaacatactgtaatgcctgacgtgccaacacattcgacacgtttaagagaaattttgcatttacaacctttacatatgcaactatttgataccacgga

SEQ ID NO: 81 - DNA, 1481 bp, Zea mays
aactaccaggacctggtgttcgccccgtacggctcccggtggcgcgcgctacggaagctgtgcgcgctccacctcttctccgccaaggccctggacgacctgcgcggcgtcagagagggcgaggtagcgctcatggtgagggagctcgcccggcagggagagcgaggacgggccgccgtggcgctgggccaggtggccaacgtctgcgcgaccaacacgctggcccgggcgcccgtgggccggcgcgtgttcgccgtcgacggaggggagggcgcgagggagttcaaggagatcgtgctcgaggtgatgcaggtgggcggggtgctcaacgtcggcgacttcgtgccggcgctccggtggctcgacccgcagggcgtggcggccaagatgaagaagctgcaccgccggttcgacgacatgatggacgagatcattgcaggttatagggaggccaggagggttgcggcagacggagaggagagcaaggatttgcttggcttgctgctgtcgatggttgacgagcggccgttcgacagcggggaagaagtcaggatcaccgaaaccgatgtcaaggcactcattttgaacctgttcgtggcagggaccgacacgacgtcgaccatagtggagtggtctctcgcagagctgatccgccacccggaaatcctgaggcaagcgcaggaggagatggacgcggtggccgggcgcgggaggctggtcacggagtcggacctccgaagcctcaccttcttcaacgcggtcatcaaggagacgttccgcctgcacccgtcgacgccgctctccctaccgcgcatggccgccgaggagtgcgaggtcgcgggctaccgcgtccccaggggctcggagctgctggtcaacgtgtggggcatcgcccgcgacccggcgctgtggcctgacccgctggagttccggccggccaggttcctgccgggcgggtcgcatgcggacgtggacgtcaaaggcgccgacttcgggctcatcccgttcggcgccggccggaggatctgcgccggcctcagctgggggctgcggatggtcacgctcaccagcgccaccctggtgcacgcgttcgactgggagttgccggcagggcagacgccggacaagctgaacatggaggaggccttcaccctcctgctgcagcgggctgttccgttagtggctcgtccagtacccaggctgctgccgtcggcgtatgagatcgcataggaaggctcgctcaagggcctcagcttggctgtatcaagcacgtacaatggcgtgaaagacgacgtgtgtatgtattgttgttcactttgttgacttttgtaaacactagtaaatgttcttgctatggctaatatctgtaacgaatttttatattttgacatgattacgcttctggcttgtaaccatgcacctttcatgtggatcaatataaactcacaatccacatgcatgaaaaaaaaaaaaaaaaaaaa

SEQ ID NO: 82 - DNA, 1967 bp, Zea mays
cggccggccatatataacaatcgtcctcgatctctcggccgagatcgatctgcgtgtgccaagggagatgggggcggcggcgccatcgtcgtggcttattgcgttcatcctgttcttcggcacgttggtagcgttgccgcagtcgtcacacggcggcggcacaaccagacactacaccttcaacgtgacgatgaagaaggtgacgcggctgtgcaccacccgcgccatcccgacggtgaacggccagttccccggccccaagatagtcaccagggagggcgaccgcgtcgtcgtcaaggtgctgaacaatgtcaaggacaacgttaccatccactggcacggcgttcggcagctgcgcacggggtggtcggacgggccagcgtacgtgacgcagtgccccatccagacggggcagagcttcgtgtacaacttcaccatcacggggcagcggggcaccctgttctggcacgcgcacgtctcctggatgcgcgccacgctctacggggccatcgtcatcctccccaagcgcggcgtgccatacccgctcccggttaaaccctacaaggacgtcccagtcatcttcggagagtggttcaacgcggatccagagacaattgtcgcccaggcgcttcagactggagcaggcccaaacgtgtcggacgccttcaccatcaacgggctcccgggccctttgtacaactgctccagcaaagacacgttcaagctgaaggtgctgcccggcaaatggtacctgctccgtctcatcaacgctgcgctcaacgacgagctcttcttctccgtcgccaaccacacgctcaccgtcgtcgacgtcgacgccgcctacgtcaagccgttccgcacggacatcgtgctcatcacgccgggccagaccaccaacgtgctcctgcgcgccgagcccgacgcggggtgccccgcggccacgcacctcatgctggcgcgcccctacggcacgggccagccgggcaccttcgacaacaccaccgtcgccgccgtgctcgagtacgcgccgccgggccacatcaggagcctcccgctcttccggccctcgctccccgcgctcaacgacacggccttcgccgcgaactacagcgccaggctccggagcctggccaccccggactacccggccaacgtgccccgcgccgtggaccgctccttcttcttcgccgtcgggctcggcaccaacccctgccccgtcaaccagacgtgccaggggcccaacgggaccatgttcacggcgtccatgaacaacgtgtccttcaacatgcccaccaccgcgctcctgcaggcgcactacggcagcgtcgccggcgtgtacacgcccgacttccccgtcgcgccgctcgagccgttcaactacactggcacgccgccgaacaacaccaacgtctcccacgggaccaaggtggtggtgctggactacaataccagcgtcgaggtggtgctgcaggccaccagcatcctcggcgccgagagccacccgctgcacctccacggattcgacttcttcgtcgtcggccaaggcttcggcaactacgactcgtccaaggacccacccaagtttaacctagtcgacccggtgcaaaggaacaccgtcggcgtgccggcagggggctgggtcgccatcaggttcttcgcggataatcccggtgtttggttcatgcattgccatctggaggtgcacacaagctgggggttgaagatggcatgggtggtcaacgatggcccgttgcctgagcagaagctgatgccgccgccggccgatcttcccaagtgctgaagatccaccgcgcgttgacattgtccaacattatgattcgtttctattgcataaacatatcaatggagatacacattgtcgtcgtacatatagcgtcgtacacagcgtttaaagaggctttgtggtttctctatgcaaaaaaaaaaaaaaaaaaaaaaaaaaaaaa

SEQ ID NO: 83 - DNA, 988 bp, Zea mays
tttgcactgcatcgtatatatccaacaaaacggcagctagagatgatggcatcctccctcctctttgttgtcgtcctcctcgcagcgctgtcatcgccgccgccgtcagccgtcctggcggcggacgactacggcaccacgcacctgcacttcttcatgcacgacgtggtgaccgggagcaacccgacggcggtgcaggtgatcaagggcgcggggtcgtcggtcgtcccggggctggcgttcggcgacaccacggtgatcgacgacgcgctgacggagacgtcgtcgcccacgtccgccgccgtgggccgcgctcagggcttctacatgatgtcgtcgcagtcgggcatcgtgctcatggtgtgcgccaacctgctgctcaccgcgggggaccacaacggcagcacgctcgcggtggtgggccgggacgacgtcgcggcggacgtgcgggagctctccgtcgtcggcggcacgggccggttcaggatggccaccggctacgtgctgtggaagacgtccagcatgaacgggcctgacgctaccgtcgagctcgacgtgcacgtgaggacggccacaaccgccgccacgggtagcggcaccactggtgccttctcgggcgccgctgccaagcgggtcggagcagggtgggtcattgcgtgcgccgtcgccgtcgttggggcggtggttggatccggcgtctggtggtgatcggctggcgtgcagtgcagtggtgcacacagtttggtgacatgtccatgactccatgtacttgcattgcttctgctagtggtcattctgaatcatcatggtggatgtagtgttggtttacttttcgcttgtttttcagttggatattatttgacctttttctgtcatgtcgagattctgggtcgaactttttcccttttgaaatgtaagtttttgttaaactaaatatgagtacatcaaattgataattaaacggaaaaaaaaaaaaaaaaaaaaaaaa

SEQ ID NO: 84 - DNA, 1905 bp, Zea mays
atcagttagcttgtctttatttcttcctccgatcactgattatacacacgcacttgatgaggttagatcgctagttaagcaagaaattagaggaggagagaggggtagccatggaagagcagcagccccgcccccgcccaagcatcatgttcgtcctgtcgtcgctcgccaagaataacccagagtccgtgctggcgctcatcgcggtgctcaccgtcgtcgccctgcgccacttgatctcctcatggcggcagcaggcccggctgcccccgtcaccgacgagcctcccggtgatcggccacctgcacctgctccgcccgccggtgcaccgcaccttccaggagctggcgtcccggatcggtccgctgatgcacatccgcctcggctccacgcactgcgtggttgccagcaccccggaggtggccagcgagctcatccgcggccacgagggcagcatctcggagcggccgctcacggcggtggcccgccagttcgcgtacgactcggccggcttcgccttcgcgccctataacacgcactggcgcttcatgaagcgcctctgcatgtcggagctgctcggcccgcgcactgtcgagcagctgcgccccgtccgccgcgccggcaccgtgtccctgctcgccgacctgctggcgtcgtcggcgcggggggagacggtggacctcacccgccatctcatccgcctctccaacacctccatcatccggatggtggccagcaccgtgcccggaagcgtcaccgacgaggcgcaggaggtggtcaaggacgtggccgagctcgtgggcgccttcaacgtcgacgactacatctccctagtccgtggctgggatctccagggcctccgcaggagagccgctggcgtccaccgccgcttcgacgcgctgctggaggacatcctcaggcacaaggaggaggcgagggcggcgcgaaggctcgaccaagacgacgacggacgtggcagcagcaagcaggacaagaagcaggccacgcacagcaaggacctgctcgacatcctcatggacaaggcagacgacccggcggcggagatcaagctcacccgggaaaacatcaaggctttcatcatcgacgtggtgactgctggttcagacacgtcggccgccatggtagagtggatgctggcggagctgatgaaccacccggagacgctgcgtaaggtggcggaggagatcgacgcggtggtcggcggcgacaggatcgccagcgaagcggacctgccacagctgccgtacctgatggcggcgtacaaggagacgttgcgtctgcacccggcagcgcccatcgcgcaccgacagtcgagcgaggagatggtggtgcgcggcttcacggtgccgccgcagacggcggtgttcatcaacgtgtgggccatcgggcgcgacccggcgtactgggaggagcccctagcgttccggccggagcggttcatgcccggcggcgccgccgagagcctggagccccgtgggcagcactttcagtacatgcccttcggcagcggccgccggggatgccccggcatgggcctggcgctacagtccgtgccggccgtgctggcggcgctcgtgcagtgcttccactgggccaccgtcgacggcgacggcggggtgaacaagatcgacatgtcggagtcggacgggctggtgtgcgctcgcaagaagccgcttctgctccgccccacgcctcgcctcacccccttcccggccgtcgtctagcgtgtcttccatggcaataccgtctatgtctgtaccaacctctaccagtaccaccacgtacgtacggattcgaagaatgtggataccatgcattaattatatgtatcacattattatatatatgatatgcaagggtaatatgcaaaaaaaaaaaaaaaaa

SEQ ID NO: 85 - DNA, 1700 bp, Zea mays
atgatggtcctgtcgtcgctcgccaagaataacccagaggccgtcctggcgctcatcgcgttcgtcaccgtcgtcgccctgcgccacttgatctcttcatggcggcagcacggccggctgcccccggggccgacgagccttccggtgatcggacacctgcacctgctccgcccgccggtgcaccgcaccttgcaggagctggcgtcccggatcggtcccctgatgcacatccgccttggctccacaaactgcgtggtggccagcagcccagaggtggccagcgagctcatccgcggccacgagggcagcatctcggcgcggccgtttacggcagtggcccgcaagttctcctacgactccgccggcttcgtcttcgagccctacaacacgcactggcgcttcatgaagcgcctctgcatgtcggagctactcggcccacgcaccgtcgagcagctgcgccccgtccgccgcgctgtcaccgtgtccctggtctccgacctgctggcgtcgtcggcgcgcggggagacggtggacatcacccgccatctcatccgcctcacaaacacctccatcatccggatggtggccagcaccgtgtccggcagcgtcaccgacgaggcgcacgagctggccaaggccgtaattgaggtcgtgggcgccttcaacgtcgacgactacatcgccgtggtccgtggctgggatttccagggcctcggcagaaaagccgccgacgtccaccgccgcttcgacgcgctgctggaggacatcctgaggcacaaggaggaggcgagggcagcgcgaaggctcgacgacggacatggcaagcaggccacgcacagcaaggacctgctcgacatcctcatggacaaggcggaggacccggcggcggaggtcaagctcacccgggaaaacatcaaggcgttcgtcatcgacgtggtgacgtctggttcagacacgtcggcggccatggcagagtggatgctggcggagctgatgaaccacccggagacgctgcgcaaggtggtagaggagatcgacgctgtggtcggcggcggcaggatcgccagcgaggcggacctgccgcagctgccgtacctgatggcggtatacaaggagacgctgcgtctgcacccggcggggcccatcgcgcaccggcagtcgacggaggagatggtggtacacggtttcaccgtgccgccgcagtcgacggtgcttatccacgtgtgggccatcggacgcgacccggcctactgggaggagcccctgttattccggccggaacggttcatgccaggcggcgctgccgagagcctggagccccgcgggaagcacttccaatacattcccttcggcagcggccgtcggggatgtcccggcatgggcctcgcgatgcagtcagtgccggccgtggtagcggcactcgtgcagtgcttttattgggccaccgtcgacggcggggtggacaagatcgacatgtcggagtcggacgggctggtgtgtgctcgtaagaagccacttctgctccgacccacatctcgcctcacccccttcccgcccgtcgtatagcgtgcatatgcgtgtcttccacgtgtcctgtatccatatttaaaatctactctacgaaatgtttatggtttggatgactatataggccaacaattggacatggtttattatgatgttattaagtgtgcaaaatt

SEQ ID NO: 86 - DNA, 2164 bp, Zea mays
cacacattattcttcctccacccatctcttgagtcgcctggccggccgccgtcttggttcccctctagagctcaacagcagagcagctgtgtagcatagagcgaggtttaaccatcagcgcatggccatggcgatctcctctgctcttccgtgctccctcctcgtggcggccctgatgctcctcgcctccgtcgtccaagtgcaaggcatcacgaggcactacgacttcaatgtgaccatggcgaacgtgacacggctgtgcgccagcaagagcatcatcacggtgaacgggcagttccccgggcccaagatcgtggcgagggaaggcgaccggctcgtcatccgcgtcaccaaccacgcccagcacaacatctcgctgcactggcacggcatccggcagctgcgcacggggtgggcggacgggccggcgtacatcacgcagtgcccgatccagacggggcagagttacgtgtacaactacaccgtcgtggggcagcgcggcacgctgtggtggcacgcgcacatctcctggctgcgcgccaccgtctacgggcccctcgtcatcctgcccaagctcggcgtcccctacccgttcccggcgccctacaaggaggtccccgtcatcttcggtgagtggtggctggcggacacggaggtggtgatcaagcaggcgcttcagctcggcgctggccccaatgtctctgacgcccacaccatcaacggcctgccagggccgctctacaactgctctgccaaagacacgtacaagctgaaggtgaagcccgggaagacgtacatgctgcgcctcatcaacgcggcgctcaacgacgagctcttcttctccgtcgccaaccactcgctcacggtcgtcgaggtcgacgccgtctacgtcaagcccttcaccgtcgacacgctgctcatcgcgccgggccagaccaccaacgtgctgctcgccgccaagccgtcctacccgggcgccaactactacatgtccgccgcgccctactccaccgccaggccggccaccttcgacaacaccaccgtcgccggcatcctcgagtacgagctgtaccccgacgcgccccggccctccgcctccgcggggagcttcaacgaggccctgccgctctacagaccgaccctgccgcagctcaacgacaccagcttcgtcggcaacttcacggccaagctccgcagcctcgcgacgccgcggtacccggcggccgtgccgcggacggtggacaggcggttcttcttcgcggtcgggctcggcacgcacccgtgccccgccaacgccacgtgccagggccccaccaacaccacgcagttcgcggcgtccgtcaacaacgtctccttcgtgctccccaccaaggcgctgctgcactcccacttcaccggcctgtccagcggcgtctactcgccggacttccccgtcgcgcccctggcgccgttcaactacacggggacgccgcccaacaacaccaacgtggccagcgggaccaagctcatggtcgtcccgtacggcgccaacgtggagctcgtcatgcagggcaccagcatcctcggcgtcgagagccacccgctgcacctgcacggcttcaacttcttcgtggtcggccaagggtacggcaactacgacccggtcaacgacccgcccaagttcaacctcgtcgaccccgtcgagcgcaacaccgtcggcgtgccggccggcggatgggtggccatccgcttcctcgccgacaaccccggggtctggttcatgcattgccatttggaggcgcacacaacatggggcctcaggatggcatggttggtgctcgacggcagcctcccgcaccagaagctgctcccgccgccgtcagacttacccaaatgttgattagactcttcctctatctctatcctgccggtcgcttcaaattaaagggaattgtgaattagacaaatgtttgtttgtttttttgtttactttcttcattgccaattgcaattttttcaacttgcattttaactagtccgttccgttcctagctgacctggacttttttgtaatttttttcttccatttgtttgccaccacaaatgtttttgtacactcctctgaaaataaagaatggcgtgacttgcaccagataaaaaaaaaaaaaaaaaaaaaaaaaaaaaa

SEQ ID NO: 87 - DNA, 1719 bp, Zea mays
gcaacttcccaacaatctcggtccctccctccctcctccctaaactccccagcaacccgcggccgagccccgtagtccgtgcaccagttgtctcgcgtcgtcgtcgtcgccggggctgcagcctgcaggcagcgacctagctaggaacgggtgacatggcgcgtgcggcggcgtcggtggccgcggcgctgctcgtcgtgctcggcgtggcagcgtcggtggcgacggcgcagatggagacctgcagcggcgacctcccacccgtgctcgccgccaactactccggcctggcctgccagccggtctggaacaacttcgtgctccggtaccaccaggacaaggacaacgtgctgcgggtggtgctgtccacgatgtacagcacggggtgggtgggcatggggttctccagggacggcctcatggtcggctccagcgccatggtggggtggatcggcaagaaggggctcccccacgtccggcagttcgcgctgcggggcaagagcagctccaaggtggtggtcgaccgtggcttcctcgtttccaacgaccacgaccacactgtcgtggtgcagcaggccaagatctacctcgccttccagctcaggttctcctaccgcctcacccaccagcacatcgtcatggccttcggcaacagcatccccgtcaagaacaggctcaccaggcaccaggacaagacctccttcaccttcgatttcacaacgggcagagcttcggtggacgggtccttcccatacggcctgcggcgtgcgcacggcgcgctgaacgtgttcgcgtggggagtcctgctgcccatcggcgccatcctggcgcgctacttccggcggatggacccgctctggttctacctccacgtgggcgtccagctcgccggcttcatcatcggcctggccggcgtcgtcgccggggtggcgctgtacaacaagatccaggccgacatccccgcgcacagggggctcggcgtcttcgtcctcttcctcggcatcctgcaggtgctggccttcttcctgcgccccagcgccgactccaagtaccgcaagtactggaactggtaccaccactgggcgggcaggctggcgctcttcttcgccgccgtcaacatcgtgctcgggatccacgtcggcggcgccgacagctcatggaagatcggatacggcttcagcctggccgtcctcctcgtcgccgtcgccgcgctcgagttcatgctgtggacgaggtggtccaagaacagcaccgccaccccgacgtactaggaacctgctgctgcacgtaccttgttgtttttccggggtcggatgatgttttgtgtttgcctttgaccttgttttttttttgttgttggtggtggtggtgtatctatatgatatatcctttggaactgcctgcaatcgcgtcagcgtgcgttcaggcaagtgcactgccactgcccgtagttacttcgttctgcacgtctggtggtgtagtggtttctctatgattctttatttgccgaggcatgttatagccgtgtctgatatttggcgacctcttcatgactgccgcctttgcagagtggattttctccacacatgtacatgtggccatatataaagacttgccctcaactatccattttgctttgaggttcgtgctggtagaaggagagagagctggaaatcagcggttgagattccttgtgtggccatgtaaaatatcataggc

SEQ ID NO: 88 - DNA, 1710 bp, Zea mays
gcttctgctcaggcacgtccgcgccccacgcccatcggctcccactctctcccaccaactttgaagcactcacttcactcgcgcttgcttcagcttcacccacgccaacgcaggcaagtacgcgaccattcccccctcgccaagcgcgcgggaagaaccaaccaaccagaaccatggccatggccacggccggcgccgtcatcgcggcatgcatcctggcgctgctggccccgccgccggcgcgcgcggcgggcggcgggcggtgcgcgggtgagtccttctccgcgaaccgcgcctacgcggcgtgcaacgacctgccccgcctcggcgcgtccatgcactggacctacgaccgcgcgtcgggcgacctccacgtcgcgttcgtcgccgcgccggccgcgccgggcggctgggtggcgtgggcgctcaacccgtcgggcgacggcatggcgggcgcgcaagcgctcgtggcggggcccttccccgacggcggcggcacgtgggccgtgcggacgtacaacgtgtccgggtacgcgctcggggagcccgggcccatcgcgttcccggcgtcggacctcgccgccgagctcggcgccgacggccgcgtcagggtcttcgggacgctcggcctcggcgccgccgccgtaggcggcgggggcgtgctgctgaaccaggtgtggcaggtcggcgccgccgtctccagcggcggcgtcccggcgccgcacgccatgggggcggacaacctcgccgccaaggccaagctggacctgctgagggcgaccaccgtagccgccggagccgacagcgccaccaggaagcgcaatgtgagagctctctctctctgctcggtctcgctctcactctcactttgtttgccttttgctccgcagtctgctgtaatgtaatgacattccttgttgtttatttttcgggcgcggcgcggaactattaaagatccatggagtcctgaacgccgtgagctggggcctgctgctgcccatgggcgccatcttcgcgaggtacctcaagacgttccgggcggcggacccggcgtggttctacctccacgtcacctgccagctgatcggctacggcgtcggcgtctccggctgggccaccggcatgaagctcggcaaggagtccaggggcgtcacctacaccgaccaccgcaacatcggcatcgcagtcttcgctctcggcacccttcaagttctggcgctgttcctgcggccgaagaaggagcacaagttccgcgtgtactggaacacgtaccaccactcggtggggtacgccgtcatcgtgctgggcgtcgtgaacatcttcaagggcatgagcatcctgggcgtggagcagcggtggaggacagcctacatcgccgccgtctgcgtgctgctcgtcgccgccgcggcgctggaggccgtcacgtggggcgtcgtcctcaggcggcgcaaggccgacggcaagaccttcagcagcgcacccaacggccacctgccgcattccgtctccgtgtgagtgggctctcgattgtatttaccggattgttatccttagtggcgtgtgtgactacgatagtaggtttagagtttgctggggttttggcctgccggcttgtattgtatgtccgttttggacggtcctctattgctctgcatacgtacatgcatacatggcatttttgtgtaaaaaaaaaaaaaaaaaaaaaaaaaa

SEQ ID NO: 89 - DNA, 2005 bp, Zea mays
cttcttttatctatagcagaagacaaattaaacccactaaacctgagaccagcaataaagccattaacatagaagaacgtccagcgtactgaagcgtacacatcagaacttttcgattggtcatcagaacttgcgaacaaaatagggtattacattccaaatgtgcagtctaattagtttacctaaccccaactcttctatataagtagtcatatcatggcgccttaattattagaaaacctgaaaacctatcctacaagatacactcttcatccaccccttacgctcagacgtcactagctagccatcatcacacaggcagcatggtgatgaaagaagcagccgaagagcacgatggccgccgcgacgtgaccgtcacggtggagccggcgctgccggtgcagcaacaccgcctgccgctgtccaacctggacctcctcctgccgccgctcgacgtcagcctcttcttctgctacctccacccggcgcccaccgcgatcgctctcaaggaggcactggccaagacgctggtggcgtactacccgttggccggggaggtggtggccaacggcgatggggagccggagctgctctgcagcggccgcggcgtggacttcacggagacggccgcggccggagtcgagctgcgggaggtccggctgggcgccgtggacgaaggcgttgagaagctggtccctgttaagaagaccggcgtgacgatggcggtcaagctgagcaagttcacgtgcggcggcgccgtcgtcggctgcaccttcgaccaccgcgtctgcgacgcctactccttcaacatgttcctcgtcgcgtgggccgcagccgcccgtggcagctctgcgccaccaccgccggacccgtgcttccgccgctccctagtcgccccacgcgacacaccacatcggcgcgcgccgtccaccgacgccctcatcaaccgcctcttctctcctcgaagcgccgcgccaccgcctccacccgccgccgcaggctccgtcaaccggatctaccgcatagccgccgaggacatcgccgcgctgaaggcctcggcggggccggggcgcacgaagatggaggcgttcacggcgctcctgtggcagctctgcgcaagggcggcctccccgcgccagagccagtgctgcatgggcgtggtcgtggacgggcgcacccggatgttcccggacggcgccatgaaggcctacttcggaaacgtgctcaccatcccgtacggcgtcatcggctccgaagacctgcgctgcatggccctcgctgacgtggccgacgacgtgcaccggtgggtggcggaggccgccaccggcgaccatttccgcgggctcgtggactgggtggaggcgctgcggcctaagccggccgcggcgagggcgtacctgggagggaccggcggcaacgaggcgatggcgtgcatcgtgtcgtccggtatgagcttcccggtgggcaaggccgacttcgggactggcctccccgcgttcgcgtcgtaccatttcccgtggcccgccggcgccgggtacgtgatgccgatgccgagcgcgcgcgggaacggcgattgggtggtgtacgtgcacgtggcgccggaggtggcgaaggtgatggaggagtccaccgtgttccaagccctggtgaacagctatgcgtttgaatgatgatggagatgggccggcatattcgtggatgcgcgcgcgttgccgtccacgcgtgtgtctagagctagtgttgatgtgcatacggcatggagttctcactactcagcagtgctaccaatttgcctcgttggttactatgtttgccagaaaataataatagtaactccatgcatatatgtcacgtgacatatgtgtaattaacaaaccaaggcctactttgcctagttaaattatgtggagaaatgtatatttggtgccctccttttggaaacccggtgggaagttagtcctatcttttgggcaacaaaaaaaaaaaaaaaaaaaaaaaaaaaaaa

SEQ ID NO: 90 - DNA, 1327 bp, Zea mays
gaccacactacccacccacctccactactgacgaccgattcccagaaagctcgatctagcgcgcgcggctgcagagtgcagacgacgacgtacaccatggcgcggcggtccctggccctgctgctcgcgtcgtcgctcgccctgatggcggccgccgtcgcgtcggcggactcgtggctctacgacaaattcaacacggacggcaccgtccgcacccagtacgacgcgtcggggcaggaggtggcgatgctcagcctggaccgcagctctggcgccggcttcaactccaaggagcagtacctgtacggcgagttcagcgtccagatgaagctcatccccggcaactccgccggcaccgtctcgtgcttctacctctcgtcgggcgacggcgacgggcacgacgagatcgacatggagttcatgggcaacgcgagcgggcagccggtggtgctgaacacgaacgtgtgggccagcggcgacggcaagaaggagcaccagttcgacctctggttcgacccctccgccgactaccacacctacaccatcatctggaacccggccaacatcctgttcaaggtggacggcgacgtgatccggtgcttcaagcgctacgccgacctgccgtacccgagcgcgaggcccatggcgctgcacgccacgctgtgggacggcagctactgggccaccgagaagggcaaggtgccggtggactggtccgccgcgcccttcgtcgtctcctaccggggctactccgccaacgcctgcgtcagcggcggggcctgcggcggcggcggcgacgacgggtggatgagcaagcagcccgacgacgccgagtggggcaccatccggtgggccgagagcaactacatgcgctacaactactgcgacgacggctggcggttcccccagggcctcccgcccgagtgcagccgcagctaagctagctgattccgccggttttcgtacgctcggcggcgtccgctgacgacacacgccttgttggtttgttcttgctggacatcatacatctctatatgcatgattcttgttctgttattgttaaatcgtgattacaatacttgtaattgtaaagaagtgtgtgggcacgggagtatatcactgtagttttaatttgcttgtaaagaaaagaagggtttttttacttgtgacgcgggagctagcgactgcgtcctgttcgcgtaaaatgtttgcaatggatgatgatgcatgtacgcagcaacagctagcagtgtactacttccacatattattgcgttcaatcaatccagatacacatttaaagttcaaaaaaaaaaaaaaaaaaaaa

SEQ ID NO: 91 - DNA, 1633 bp, Zea mays
gttaggaggtgcagttatagcagacgcagagcaatggaggccgccgaggctcctaactatgacagtattgtcaacagggatgagatcaccgacgctgcagctgcagcgttcgccaacccggagcaggtcccggagaagtacgtccggacggaggaggtccttgacggcgtcgtcgtcggcgcggacgagagctacgagctgccggtcgtcgacatggccaggctcctcgacccggagctggcgccgtcggaggtcgccaagctcggcgacgcctgccgaaactggggtttctttcagctgacaaaccatggagtggacgaagcggtggtgcagcggatgaaaaacgccacggtgcagttcttcagctccccgctggacagcaaggccaaggtggcggtccgagggaacggcttcgaaggattcgggcaccactacagcagagcgtccagcggcaagctggactgggcagagagcatgattctcatcacgcagccagtcaaggacaggaacatggagatgtggcctacaaatccacccacgttcagggacgcgctcgacgtctactcggtagagatgatcggcctcgcaatgcggctcctggggttcatggcggccgacctcggggtggagccggaggcgctgcaggacgccttcacggggaagcggcagagcatggcggtccaccactacccgccctgccgccagcgggagaaggtgatgggcatcacgccgcacacggacgggctgggcctcacgctgctgctgcacgtggacgacacgcccggcctgcagatccgcaggggcggcaggtggttccccgtgcgcccgctgccgggcgccttcgtcgtcaacgtcgccgacatcctggacgtgctcaccaacggcgcctacgccagcgtcgagcaccgagtgctcccggacgccgagagggctcggaccaccgtcgtcgtgttccaggaggcgtccgtcgggggcctggtggcgccgctgccggggctcctcgaccagcagggcgcgcgcgcgcgctacaggtccattgagatcgaggagtacatcaagggcaacttcaacgcgctggagcaagggacacggttcatccagagcctcaggatatagctatctagttgctccttccatcaaaaaataattacccaacatatcgataaatcaatcaatctcaatcttcaccaatcatatccataccttccgtatctaatattaaagagagtgttaatttcttcctccaatctctatactacttcttaagacgttattgtaggcgtccacagattattttggtccgatccctctgcccacccacctccccctctgctccccgccatcaacgcgacgccgatccgccatcaacaccgatccagggccgccccacccaccaccctcctcgatccgccttcaacgtgtcgcggatcccccaccctcctcgatctttgctcctcgccatcaacgcgacgccgagggtgctcgcccagatggtgctcgcccgaatggtgcgcccgccccgctcaccttccatcgacggggccaccccacccaccgccctcctcgatccaccatcaactgtcgtggatcccccaccctcctcgatctctcctccctgccatcaacgcgacac

SEQ ID NO: 92 - DNA, 859 bp, Zea mays
agtataaagttggacatgttcacagcaggcacggacacatcgtcgatcatcgtggagtgggcgatggccgaaatgctcaagaacccggccgtcatggcgcgcgcgcaggaggagctggaccacgtgttgggccgcggccggcgcctggaggagtcggacctgcccagcctcccctacctgcaggctgtgtgcaaggaggccctgcggctgcacccgtccacgccgctcagcctcccgcacttctccttcgacgcctgcgacgtcgacggctaccgcgtcccggccaacacccggctgctcgtcaacgtctgggccatcggccgggacccggccacgtgggaggcgcccctcgagttccggcccgagcggttcctgccgggggccgcggcgaaggtcgacccgctcggcaactacttcgagctcatccccttcggcgccggccggaggatctgcgccgggaagctggcgggcatggtgttcgtgcagtacttcctgggcactctgctgcacgcgttcgactggcgccttcccgacggcgaggagctggacatgcgcgagacgtttgggctcacggtgcctaaggccgtaccgctccgcgccatcgtcacgccgcggctcctgccagaagcctacgcctgagaaggtttgtgcccatgatcatgacggaaggatgattgcctgaaggtttgtgcttgtcaaccctgtatgcgtattctgtttctgttttttttatagaaacatggtattcacattcctatgcttaattgccaggcatttgatatgtcggattaaaaagtttgtcaacaagctactgaacaaatgattattcggattatcaaaatgaatttttacagacagt

SEQ ID NO: 93 - DNA, 1096 bp, Zea mays
cccagctgcatctgcattgcattgcatgcacaggtcgcgcccaccatcagtagcggtcgccgccatgcagagactcgtgcgcgtcctcgtggtgctgggcgtggccgccgcggcgtcggcgcagggcccgacggcggcgccaacgacgcccacgccggcaacccccgcggcgcccgcgcccgcgacggcgtccagcaacatcacgggcgtgctggccaaggccgggcagttcaacaccttcatccggctgctcaagtccacgggcgtggcgtcgcagatcgacaaccaggtcgccaacggcgggaacggggtcacggtgttcgcgcccacggacaacgcgttccagtcgctgccctcgggcacgctcaactcgctgtcggaccaggacaagaacgcgctggtgcagtaccacgtggtgtccaccgccatccccatgtcgcagttcgacaccgtcagcaacccgctccgcacgcaggccggcagcgcctcgccgggggagttcccactcaacgtcacctcctccgagggccagcaggtcaacgtcaccacgggcgtcgtcaccgccaccgtcgacaactccctctactcgggcgacagcctcgtcgtctaccaggtcaacaaggtgctgctccccatgaagctcttcggcgccgcggaggcgcccgcgcccgcgccgctcgcgccggccaagaagaagggcaagacgccggcggccgtcgccgactcgcccgacgcggcggaggcgtccccggacgccacgaccacgtcgctcgcgcccgcgaggctgacgcggggtggcctcgccacggctcttgcgctcgccggcgtttggtgggggctgtagtcacggcgaggagtgtctcgtcaggtctctccggtggccgtgacatctatactttttttttcgttcgcgggtcttgtttgtcttttcgtttttactttattgcccatttttggatgaattgttcttccctgtcattcaaattgctaggagtatgtcatgtcatgtaacgtccttgtcccatttttatgtaatgttaactaaataaatatgagttgtgtatatttcagtaaaaaaaaaaaaaaaaaaaaaaaa

SEQ ID NO: 94 - DNA, 1599 bp, Zea mays
ggacaggcagccaaatgccccaccacagcgtagcccctcctcactgactcacctgcaaaaaccacttgcaaaccacacaaaccgaaaccgccagctcccctgcctccatttttagcaacttttcccttcaatctcccgtcgcagtcacccttcttgcacccccgcgcagcttccgacacctccgaccttctctggcggcgccccgccgttggacgctcatggagaagagccgtccgggcgccgcgccgacaccatcgccagaggaggaggtggcggcggagggccacgcgcacggtgacgacgcgacggggcagaaggagcaggcgacgccagtggtgctcaagaagggcccgtggacggcagcggaggatgccatgctcatggaccacgtccggcaccacggcgaggggaactggaacgcagtgcagaggatgacaggcctgctgcgctgcggcaagagctgccgcctgcgctggaccaaccacctccgccccaacctcaagcgcggcagcttctcgcagcaggaggaggacctcatcgtcgcgctccacgagatcctggggaacaggtggtcgcagatcgcgtcgcacttgccggggcggacggacaacgagatcaagaacttctggaacacgtgcctcaagaagaagctccggcagcgcggcatcgacccggccacgcacaagccagtcgccgcggcggaggcgagcgcggcgctgccggacgctcgagaccacgaccgtgagcccggaggagccggcgccggcgccgacgccgacggcctggcgcagcagagcaagcagccggcggcggccgtgttcgacccgttccctgtggtcgacttcggcttcgacctgagcggcggcggcggcgtggcggcattgtacggcggcccgtacgacgccgccgccggcaaggcgtcggcggacgacggcgggttcgtggccgactacagcagcgtgctggacgtgtcggagaacctgggatacggggagagctccagcaacagcagcaactgggggaacggcgcggagatgggcaatgccgccgccgccgtgctcgacggcgaggtgctgcactgggccaagccggagccgtacacggagctggagcagcggagcgcggggcaagccgccgcggacgacgacgcgctgcatcataggttcttgctgccctgcggccaggagcagagcctggcgcatctcgacttcggcttggaatacttctgatcctcttcctcccgcttttgtttttggcccttcgttcgtctctgcctttgcctttgcctttcctccctccctgaattatccatccatccatccattccccctacgtcatttggaagattagggattgtacgtagtaaccaatatgttaatttctctctagcccatgaatgatacacacacacacactctttctatctttctctaccttttctgtatactctgctcctgctcggtcggaggaacataagccaatggtacgtacatacgggattattgtgtactacaatatatacaatatacaaaaggtgtttccttttttgtaaagaataaattaaacctgcagttgttttaaaaaaaaaaaaaaaaaaaa

SEQ ID NO: 95 - DNA, 1655 bp, Zea mays
cgcacctaccgtccagcgtccgagacgagacctcaccacaccagcctcgcaatccaaaccatagtttaattagccaggctagcagtagcagctgtggtcgtcctcgcttgcttgcttgctaccagggtttgtgtgagtgtgttagtgagagagaaccatggcgacgcagcggttcacggcggcgctggtggcctgcctcctcctgctcctggcgctgccggcgcgcgggcgcaacatcacggccatcctcgccgggtacaaggagtacaagctatacaaccagtacctgtcggagacgaaggtgtgcgacgagatcaactcgcggcagtcgacgtcgatgtccgtcctggtgctgtccaacgacgccatgacgacgctggcctccgacgccggcgactcgctccccgccatcaagaacgcgctgcgcctccactcggtgctcgactactacgaccgcaagaaggtgaagaagtacggcgacgagagcgccgccacgctgtaccaggccacgggcgacgccgccagcaccacggggaacgtcaaggtggtggaccaggaggacaagaactacggcttctcggccgccacgccgggcgccaggatctgcaccgtcaccaaggaggtggagacgcaccctttcaagttcgccatcctcgaggtcacggcgcccatcgagttcgacggcctcttcgacaccccctccaccgacaacctcacccgcctcctggagcgcgccggctgcaaggtcttcgcgtcgctggccgcctccacgggcgtgctcaagacgtacgaggccgccatggacaagggcctcaccctgttcgccgtcaacgacgacgccttccaggccaaggacgcgcccgacgtcaaggccatgtccaaggccaacctcaccaagctcctccagtaccacgccctgccttcctacaacaccaagacctcgctcaagtccgtcaagggcccgctccgcacgctggccgccaaggccgacgtcacggtggtcgccaagggcgacgacgtctcgctcgacaccggcaagagcaggtcccgcgtcgcgtccaccgtcgtcgacagcgtcccgttctgcctgctcaccatggacaccctcctggtgccgccggagctctacgtcggcgccccggaggcggcaccggcgccggcgccagcggacgcgccacaggggtccccgcccgcggcggacgccccgtcggtggccgcggaccacgccgaccacaagtccaagaagccgtcggcgtcgtccgccgtcgcgtggcgaccggccggcgcgctcgccgcggtggccgtgtgctccgtcgtgctggcctccctcttgtgatgcattgttgcttgacagctcctccgacctctgcttcctccgatccaagcagatacccgtttctctgtgatctctctcccccgctctgttccggtccttgcttcattgaatctgttggtgcattgccatttccacatgtaatttgagcaaacatgtacatttcccccttttttcatgatagtttcagaacacaatattctaagcagctgcgccattccatttcgcgcaacggctttctctcggatcctgagacccattcatgtagtgaaaggagaagtcaaacgagaagaacaaatctgaaagctaagatttttttttt

SEQ ID NO: 96 - DNA, 1234 bp, Zea mays
cctccactcatcctaagtttgctaatttgcctctcctcacttcactagttcacttcacctcacttgcgccatcgcccccgccgtcacgacaccacccagccgcaacagtagattacctcgatctctcagagggccagcaaggcggaggaggagagccatgtccagccccacgcacgcccgcaaggccatccacctggcctccctgcgagccaggctcgcgcagcagggcaaggccggcgtggcgctgcgcctgctcctcgccgccgcgctcgccggcttcctcctcgtcttcgccgcgcgcaccctggtcacgtcgcctgtcccggcatcgccctcgtactcatactcgtcggagccgcagccgcatccgctgccgctgcccgtggcggaggcgctggtgcactacgccacgtccaacgcgacgccgcagcagacggcggaggagatcggggtggcgctgcgcgtgctgcagcggcgcgcgccctgcaacttcctggtgttcggtctgggcctcgacagccccatgtgggcggcgctgaaccacggggggcggaccgtgttcctggaggaggacgcggcgtggatcggcagcgtgcggggcaggcacccggcgctggagtcccaccacgtggcctacgacacggcgctggccgacgccgacgcgctgctagggctccgcgcccacccggcctgcgtcgcgcagcccgacctcgcggcggccgccgccgcgtcctgccgcctcgcgctccggggcctcccgcccgtcttcgccggcctcgactgggacctcgtcatggtggacgcgcccacggggtggacgccccgggcgcccggccgcatgggcgccatctacaccgccggcatggcggcgcgcgcgcgcaggccaggggccggccccacccacgtcttcgtccacgacgtcgaccgccccgtcgaggacgccttctccagggcgttcctgtgcgagggctacctcgccgaacaggtcggacggatcaggcacttcgtcatcccgtcacaccgcgacaaggacggcacgccattctgcccttgacaagagtttgttctgctttggtttggatcccacggtgccaattgccaaactactacagtactattattgctgcatagatgttgctttgcagtttttcattctacactgatgagtgcctgagagttgggtagacgacgattacaatgtaaaattcagagcttgcattgtctgttaggcctt

SEQ ID NO: 97 - DNA, 1269 bp, Zea mays
gttcatagctagctagttcgcctcccaaaaacacctgccctcgtgcgtggcaggagcacgggcacgatgatcagcacagcgcacagccggcagcagcaccatgccttcgagaagagccctggcaacagccacatgaagagcatcgacaggaagctgcagcaggccatgagccaggcggccagcaagtacatgcagaggatctaccctctaggcatgcagaggagcagctccagcctcacattgtcgtcgctctcgctgtcgcagaactccaacgactcctccatcagcagctccaactccagctgggagcccaaggtgccgctgctctacggcggcaccttcagcccatggggcgacgtcatggtgtctcgggagatgaggcgggaggacgatgacaaggtcagtgaccatgacgtcgaaggaggcgaggaggacttggactgcagtgagccggggagcctgcgtaggtgcagctggatcaccaagaacagtgacgaggcgtacgtccagttccacgacgagtgctggggcgtccctgtgtacagcgacaaccggctgttcgagcttctgtcgctgtcagggatgctgatcgaccacaactggacggagatactgaagcggcgggacatgtacagggaggcgttcgccgacttcgaccccagcgcggtggcgcggatggaggaggaggacgtggcggagatcagcggcgacagggagctgaggatcgccgagtgcagggtccggtgcatcgtggagaacgccaggtgcatccagagggtggccagggagttcggctccttcagcggctacatgtggggccacgtgaaccaccggccggtggtgggcaagtaccgccaccacaagtacatcccgttccggacgcccaagtcggaggcggtgagcaaggacctcgtccgccggggcttccgcctcgtcggccccgtcatcgtctactctttcatgcaggccgccggcatggccatcgaccacctcgtcgactgcttccgcttccacgactgcgtccgcctcgccgagcgctcctggggcatcaccaacgtcgccgcgtaggcgtagccagccggcccctcaatatctgtgcatgcatgcctctccaagtttttcacaccttcttcttggtgttgttattgtttttttgtttggagatcggaattgtgtgtgaaattacgtagagtatgtactctactaagttatgatgtaatacttctattaactctttgccaatgaaaagtagtactgaactaaaaaaaa

SEQ ID NO: 98 - DNA, 1580 bp, Zea mays
gcttctgctcaggcacgtccgcgccccacgcccatcggctcccactctctcccaccaactttgaagcactcacttcactcgcgcttgcttcagcttcacccacgccaacgcaggcaagtacgcgaccattcccccctcgccaagcgcgcgggaagaaccaaccaaccagaaccatggccatggccacggccggcgccgtcatcgcggcatgcatcctggcgctgctggccccgccgccggcgcgcgcggcgggcggcgggcggtgcgcgggtgagtccttctccgcgaaccgcgcctacgcggcgtgcaacgacctgccccgcctcggcgcgtccatgcactggacctacgaccgcgcgtcgggcgacctccacgtcgcgttcgtcgccgcgccggccgcgccgggcggctgggtggcgtgggcgctcaacccgtcgggcgacggcatggcgggcgcgcaagcgctcgtggcggggcccttccccgacggcggcggcacgtgggccgtgcggacgtacaacgtgtccgggtacgcgctcggggagcccgggcccatcgcgttcccggcgtcggacctcgccgccgagctcggcgccgacggccgcgtcagggtcttcgggacgctcggcctcggcgccgccgccgtaggcggcgggggcgtgctgctgaaccaggtgtggcaggtcggcgccgccgtctccagcggcggcgtcccggcgccgcacgccatgggggcggacaacctcgccgccaaggccaagctggacctgctgagggcgaccaccgtagccgccggagccgacagcgccaccaggaagcgcaatatccatggagtcctgaacgccgtgagctggggcctgctgctgcccatgggcgccatcttcgcgaggtacctcaagacgttccgggcggcggacccggcgtggttctacctccacgtcacctgccagctgatcggctacggcgtcggcgtctccggctgggccaccggcatgaagctcggcaaggagtccaggggcgtcacctacaccgaccaccgcaacatcggcatcgcagtcttcgctctcggcacccttcaagttctggcgctgttcctgcggccgaagaaggagcacaagttccgcgtgtactggaacacgtaccaccactcggtggggtacgccgtcatcgtgctgggcgtcgtgaacatcttcaagggcatgagcatcctgggcgtggagcagcggtggaggacagcctacatcgccgccgtctgcgtgctgctcgtcgccgccgcggcgctggaggccgtcacgtggggcgtcgtcctcaggcggcgcaaggccgacggcaagaccttcagcagcgcacccaacggccacctgccgcattccgtctccgtgtgagtgggctctcgattgtatttaccggattgttatccttagtggcgtgtgtgactacgatagtaggtttagagtttgctggggttttggcctgccggcttgtattgtatgtccgttttggacggtcctctattgctctgcatacgtacatgcatacatggcatttttgtgtaaaaaaaaaaaaaaaaaaaaaaaaaa

SEQ ID NO: 99 - DNA, 1626 bp, Zea mays
atgttccagcagtgcccgatcgagtccctgcctgcctgcctgcccttttctatgtgctggggatgcagaagggacaggagtgggcgaggatatatgccgttgtgccgtgctgtttcggtggcggcgctggaccatcccccgcccgccgctgccgccgcggtgcccaaggaggaggtgtgggaggtccggcccggcgggatgctggtgcagaagcggagccccgacgcggacccgccccccggcggcgcgcccgtgcccaccatccgcgtcaaggtcaagttcaacggcgtctaccacgagatctacatcaactcccaggcatccttcggcgagctcaagaagctgctgtcggagaagacgggcctgcacccggacgaccagaaggtggtgtacaaggacaaggagagggactccaaggcgttcctggacatggccggcgtcaaggaccgctccaagatggtcatgctcgaggaccccgccgccaaggccaagcgcctcctcgaggagcgccggaccggcaaggccgagcgcgccgccaaggccatcgcccgcgccgccctcgacgtcgacaagctcgcaaccaaggtgtcggcgctggagacgatcgtgagcaagggcggcaaggtcgtggacgcggacgtggtgacgctgaccgaggcgctgatgaacgagctggtgaagctggactccgtcgccgccgaaggggaggtgaaggcggcgcggcgggcgcaggagaagcgggtgcagaagtacgtggagacgctggacgccatccgcgccaagaacaaggcggcggcggcggcggcgccggccaaggcccgcagcggcagcaacaaggcgcggccgccgcgcccgcccccggcttcggcgcacgcgcatcagagccagcagcagcgccggcagttccagccgccggcgccggtgtcgcagacccagacggcgagctgggagacgttcgacctcctgtcgtcagtgccgtcgacgtcggcggcccccgtgacgaccatggcccccgcgaccagcaccacgccgtccccgcgcttcgactgggagctcttctagatggctcctcaaggcgccagcctgccacacccccctggcctggcccccatctctcgccacttgtgtgcctgtccattggctcggccagtaccttctcctgttcgccttggccatggtgcatgtcaatcgccattgtttctttctttctttccttcccgctctctttattctgtcattcttgctgtcctttgagcgattgaaagtctgtgtatattgcatttgcatgatctctccacaccctccccccccccaccccacccaccccagaaaaaaaggaaacaactgcagtgagagtgagctactagtgaacagaacagaacagaacagaagcgcatgcgtccatggtgtgtctgtgtgcaaaataagtggtggcctcgtaaccgaaccgacgaaggatttttttgccatgaccatatatgatatgttgttgtatgtatagtagtgcagcagtgtacatgaatcagacaatgttctcaacgtacgtgtttccttgtgctagctcccggatgtaatgtaaatgaatggtatactatatgaatctatgatggatggcccacccattcc

SEQ ID NO: 100 - DNA, 833 bp, Zea mays
ccggagcgcacggcggcggcctcctgccgaccttcgcggtagcaagctagcagctagctagccgcagttagcgtctctttcgtccgtcctcctgcgccggccgtcatgaccttcccgctggtttgctactgcaacgcggtgccgcgccccgtggccgcgctgttcaagaccatccacgccgcggcgctggtggtcgtgctggtcctctgcttcctgggcctctacgagttcccctacgaccccgaggaccacgcgccggtgatcaacgggcgggcccgcggcgggcgggacgcccctgggccggaggcggtgaagcggcacctcccgctcgtcgagttcctggagctgatggtggtggctccgtcgccgtcgtcgggggcggaggcggctccgacgtgccgggtgtgcctggagaggctggaggcggcggacggggtgcggcggctgggaaactgcgcccacgcgttccacgcgcgctgcatcgaccgctggatcgacctgggcgaggtgacgtgcccgctgtgccgctcccacctgctgccgcgccggcgcgccggcctgcttggcatggcacggcttggcgacggctagtatagtcgcccgtccgtccgtacctggttgtttccttgccacgtgacgtgcgtgcccgtgcccgtgtgcttggctttcaggcgcgcggcactggtgccggatgggggcggaccaaccgtgaactgatcgcgattaggacgatggactaaccaccaacctgatgttattaatgaatgggcgcaagttaaattaaccggaggaggttggcataaagtacttgttgacgcgataccatatattgt

SEQ ID NO: 101 - DNA, 2065 bp, Zea mays
atcgaatcgaacgcgatcccctcccccctcaccccctaatttcactcggatccatgcctgtgtgtgctagctgccgtcgtcggccttgcctcgcaaaagtacccccaaccccccactatatataagtgcagcgcctttcctcccctgccaccaccagcttccctcctagctcttctctttcctcatcatcgtcttcctcccctcacatcctctggcctctggtcctccaccgtcctgctagccagagctgctcttgtacgcgcagctggcctctgtgcatatcaccagcacaccgcgcaggggaaggaaattaacaagagaaaaggcaaggagagcaggcaggcaaggaagctgcagaagccaaggaaggagaaggaggatcatcaatgagcatctcggtgaacgggcagtcgtgcgtgccgccggggttccgcttccaccccacggaggaggagctgctcaactactacctccgcaagaaggtggcctcccaggagatcgacctcgacgtcatccgcgacgtcgacctcaacaagctcgagccatgggacatccaagagaaatgcaagatcgggtcgggtccccagaacgactggtacttcttcagccacaaggacaagaagtacccgacggggacgcgcaccaaccgcgccacggccgccgggttctggaaggccaccggccgcgacaaggccatctacaacgccgtcaagcgcatcggcatgcgcaagacgctcgtcttctacaagggccgcgcgccgcacggccagaagtccgactggatcatgcacgagtaccgcctcgacgaccccgctgctgctgctgctgctggatccggtgatgccgtggccaacgacgacgcagccgccacggctgctgctgctgccgccgcgtcgtcggacggcgggcaggaggacggctgggtggtgtgcagggtgttcaagaagaagcaccaccacaaggagtcaggtgggggcgggggcaacaagcacggcagcagtaacagcgagcatgggcacggcggcgccggcaaggcatcggctgcggctgcggctgcggcgcaccagcaccagcaccatggaggcctgcagtactcctccagcgacgaggcgctggaccagatcctgcagtacatgggcaggtcgtgcaagcaggagcacgagctggtgtcgccggcgccggcgccgccgggacgggcggcggcgtccaggtacctccggcccatcgagaccgttctgggcgggcacgcgttcatgaagcttcccgcgctcgagagcccgtccgcggccgcgtccgcatcgctgacacagccggcgcagcacgacgagctctaccgcgccgccgggaacgggatcacggactgggccatgatggaccggctggtggcgtcgcacctgaacgggcagcaggcgcccgccgcggcggaccagctcggcggcggctgcggcttcgacgcggacgccggcgccgaagacgcggacgccggcctcgccttctactccgccgccgccagccggctgctcggctccggcggcggcgccggcagcgacgacgacctgtggagcttcacgcggtcgtcggtttcgtcaacggcggcggcggcggccacgtccacggagcggctcagccacgtgtcactgtagacgccgttcttcgtcgccgtcgccgtcgccttaactatgtacgtacgtacgtcgtaagcccctacgtgatgacatggccagcatgccctggtggtacacgtactagtaaagaagagacaaacaccaacagcaggagcagagagagagaaagaggaaataaaagaagggtctctagagagagagagagtgatttcagaggaggtgattagagtgatgagagagactgaaagtagatcgatggatcgctgattcgctgatacgattaaagctggcagtaagttggagtggcactgtcactcggacgccacatgcatcatctctcctttctatagcttcattctctctccatcatctcagccactgtttaattaacccccggccaccgattgttattactataatatataaccacagcattttac

SEQ ID NO: 102 - DNA, 1787 bp, Zea mays
cgtcctgcccacgcgacgcgagagcgggagcggtgggtcgagtgacgagctggaccccgccgctagtcccctacccctgcctgctcccccccgcctgccccgtgtttatatctgccgcgccgcacagggagagagtcgagtccagctcggcaggtcagtcagtagtggatagctccgctcgcggtcgcgggcggctcgagtcgcaccccagatcccaatgcgccccgccgcgccgcactaggccgcggaacggaagctaggtgcgtcacacgccggggccggtcgcggtcaccggaccggacgcacaggggcgccgtacgtgcagtcatcggccatgaaggtcctcgtcctcgccgtgctggcgctcgtcgccgccgcctccgccgctggtcagggcgaggaggggggcgggccgccgctgccgttcgcgttgggcgcggcgccggcgggctgcgacgtcgcgcagggcgagtgggtgcgcgacgacgacgcccgcccatggtaccaggaatgggagtgcccctacatccagccgcagctgacgtgccaggcgcacggccgccccgacaaggcgtaccagagctggcgctggcagccgcggggctgctcgctgcccagcttcaacgcgacgctgatgctggagatgctgcgggggaagcggatgctgttcgtgggtgactcgctgaaccgggggcagtacgtgtccctcctctgcctcctgcaccgggccatccccgacggcgccaagtcgttcgagacggtggactcgctgagcgtcttccgggcgaagaactacgacgccaccatcgagttctactgggcgccgatgctggccgagtccaactccgacgacgccgtggtgcactccgccgacgaccgcctcatccgcggcgcgcccatggacaggcactacagcttctggaagggcgccgacgtcctcgtcttcaactcctacctctggtgggtcgccggggacaagatccagatcctgaggggcgccgacaacgacccgagcaaggacatcgtggagatgaagtcggaggaggcctaccggctggtgctgcaccaggtggtccggtggctggagcgcaacgtggaccccggcaagtcgcgggtgttcttcgtcaccgcttcgccgacgcacacggacggcagggcgtggggcgacgacgacgcggagggcagcggcaactgctacaaccagacgtcgccgatcagcgccgcctcgtcctaccgtggcggcacgagccgggagatgctgcgcgcgacggaggaggtgctggccacgtcgcgggtgcccgtcgggctggtcaacatcacgcggctgtccgagtaccgccgggacgcgcacacgcagacctacaagaagcagtgggtggagccgacggccgagcagcgcgccgaccccaggagctacgccgactgcacgcactggtgcctccccggcgtgccggacacgtggaacgagctgctctactggaagctcttcttccccagcaacgatcaggtcctctgatggtgcattggtgcctgcatacatacgcctggaaaccaactgctaggggctagcccaaagaaaatgtgtctagatgaacaaagacatggggttcaaatgttttgttttgatttcggatatggacgctgtcgatgctcttgttctctgtggaattcttcttaccaactgtgcctcccatatatacatcactactgatactagaatctatgctgatattttctttcgttaaaaaaagcgacagtgaagcgtagaagcacctacaagagttttc

SEQ ID NO: 103 - DNA, 726 bp, Zea mays
gcaagcacaagcactgcaccgaacgagcagcgagcgtgttgaggcaggcagtcagtggcagtgggagtaggagacaaggctaccgagatgaagggcctcttgttgctcgtcatcgccctggtcgcgtccgctgcatgcctcgtgaccgtccgcggcgcgggcgagtgcggggcgacgccgccggacaggatggcgctgaagctggcgccgtgcgcgtccgcggcgcagaaccccagctcggcgccgtccaacggctgctgcacggcggtgcacaccatcgggaagcagagcccccagtgcctctgcgccgtcatgctgtccaagacggccaagaagtccgggatcaagcccgaggtggccatcaccatccccaagcgctgcaacctcgtcgaccgccccgtcggctacaagtgcggagattacactctgccatgagctgcgcgagagctgcttgagcacatgtgcatgatccgtcggagttagcacgacgtccgcaggaagtgatggtgacgtgtcagtgtatgtgtgcgttggtaataaacgtcgcggcacttgttgtgattaccatacatgtggaagtccagtgtgatatgagtgtctcacaatcttcaaaagaaatatgggtcgtatcgtatgtaagtgtcagggttccagagatgctgtcctgcatcctcgaaataaaacttgtcttcttggacagatttggttaaaaaaaaaaaaaaaaaa

SEQ ID NO: 104 - DNA, 2220 bp, Zea mays
cttgcttcaaagcgcaaacacacaagaagggcggagctgttgtcatcctgacaatgggcgcgcgtcgtggtctccggcgaggccaagccgccgccgccgccttctccgcatgtcccttcctcgccctcgccgtcgtcctcctcgccttgccggagctcgcagccggcgacacccactactacacgttcaacgtgcaaatgaccaacgtgacacggctgtgcgtgactaagagcatcccgacggtgaacggggagttcccggggccgaagctggtcgtgcgggaaggcgaccgcctcgtggtcaaggttcacaaccacatcaactacaatgtctcgttccactggcacggcgtccggcagctgcgcaacgggtgggcggacgggccgtcgtacatcacgcagtgcccgatccagggcgggcagagctacgtgtacgacttcaccgtcacggggcagcgcggcacgctgtggtggcacgcgcacttctcctggctgcgcgtgcacctctacggcccgctcgtcatcctccccaagcgcggcgagggctacccgttcccgcgcccctacaaggaggtgcccatcctcttcggcgaatggttcaacgcggacacggaggccgtcatcaaccaggccctgcaaacaggcgccggcccaaacgtctccgatgcctacaccttcaatgggcttccaggcccgacatataactgctcgtctaaagacacgtacaagctgaaggtgaagcccgggaggacgtacatgctccggctcatcaactccgccctcaacgacgagctcttcttcggcatcgccaaccacacgctcaccgtcgtcgaggcggacgccagctacgtcaagccattcaccgtcagcacgctcgtcatttcaccggggcagaccatgaacgtgctcctcacgacggcccccagccccgcctccccggcctacgccatggcgatcgcgccctacaccaacacgcagggcacgttcgacaacaccaccgccgcggccgtcctcgagtacgccccgacgacgaccaggaacaacaccctgcctcccctaccggcyctgccgctgtacaacgacaccggcgcggtgtccaacttctcgcgcaatttccgcagcctgaacagcgcgcgctacccggcgcgcgtgccggtggcggtggaccggcacctgctgttcaccgtggggctcggcacggacccgtgcccgtacaccaaccagacgtgccagggccccaacggcaccaagttcgcggcgtccgtcaacaacaactccttcttccgcccccggaccgcgctcctcgaggcgcactaccggcgccgctacgccggcgtgctcctggccgacttccccacggccccgccgcacccgttcaactacacgggcaccccgcccaacaacacgttcgtgcagcacggcacgcgggtggtgccgctccgcttcaacgcctccgtggagctggtgctgcagggcaccagcatccagggcgccgagagccacccgctgcacctgcacggctacaacttcttcgtggtcggccaagggttcggcaacttcgacccggtgaacgacccgcccgggtacaacctcgccgaccccgtagagcgcaacaccatcagcgtgcccaccgccggctgggtcgccgtccggttcctygccgacaacccgggcgtgtggctgatgcattgccacttcgacgtgcacttgagctggggcctgtccatggcgtggcttgtcaacgacggcccgctgccgaacgagaagatgttgcccccgccatccgacctcccaaaatgctgatgacgactggtcgtttatcacccgatcgaggggtagatgggcatttaggaaggttctcctgcttcctgcacgtctgcctacttcctttccttacgatgtttggaactatttggtttggactatttaattaccgtgtgccgatttttggcgagtgcttggatttcgcgatcctcgctgaatccccttttgaaacatgttaatctgtatctatgtaacgacaacgtttgttctgcggttacttgttctttttttaccccctttctgaacattcagcacgcattggtgtattcacatggtcaaatacaatgtaacaatgatgtctgtatgttatgactccctgagtttctctctctctctctaagtctctctctctctctctgtgtgtgtgtgtgtgtatatatcatatcgttcagtacag

SEQ ID NO: 105 - DNA, 1311 bp, Zea mays
ccattttcgccgagggagcccgcagcagcagctgccacccatacgaacatctcagcattttttttgtttaatttttaatgtttcttctcccgcccgacacgaaagaacgccgcggttttatatactacgccccctcttcatagcgctccttcgagttcgagctgccaccgtctctccttcctccgtcccctcttccctgctctgctccatcagggcaggggcttgcatcagagaaggtagtagagaggatcaggtgcgcgagacagacgctgcaatgatggagtccaaggcagcaattattcttgccgcggctgtactggccgtcctcttcgccccggcattgggtcagaagagcagcccgccggcgccggcgcccatgtcgctgccgccgaccccggcaccggcgccggcgccgcactacgtggacctcgcggagctcctgagcgtggcgggcccgttccacacgttcctcaactacctggagaagagcaacgtgatcgagaccttccaggggcaggccaacaacaccaaggtgggcatcaccgtgttcgtgcccaaggactcggcgttctcggcgctgaagcagtccaccttctccaacctcaccgccgaccagctgaagacgctgctgctgtaccacgcgttgcccaagttctactccctggccgagttcaagaacctgagctcgctcaacccggtgaacaccttcgccgggtcgccctacacgctcaacctcaccgacgacatgggcagcatctacgtgcagtccatgtggtccaggcccaagatcgccagcagcgtgtacgccaccaggcccgtcgccgtctacgcgctcaacaaggtgctcctgcccatgcagctcttcagcaaggacccgccgctggcgccggtgcccgcgcccgccccggagcccggcgcgtccgacgcccccggcccggcggccggcaaggccggcgggctgagggcggcaagggtgactccaccagcgccgcgcgacacgggcgccgtcggcgttgccagttccttgctgctcgccgccgcagcaggctgcttgattctccagtggtgaggagacttgtggttgtgggtccgttcttgccatgtgtggtgttcgtgcttcccctgccccccacacttgatttcgtcttgaatgggttgctggagtcattcttttggacataatgtaggcataccgttaggatcgagctggagtactttttttacgtcacgttacattactgtcataatttccatcattttttgatggacggatgattgaacgaatgaatacgagaagaagttttcactgct

SEQ ID NO: 106 - DNA, 688 bp, Zea mays
ggcgaagtttgaagagcgacggccgacgactgaagcaataatggccgctcctctatgctcttccgtttccgtgtctctcatgctgctactgctagtgctctcggcctcggcctcggcggcgtccgccgcggacgggaagctgatccacctccacttctacttccacgaggtcgacgccggcacgcccaacgccaccgtggtcaacgtcgccagcctgcacaagaacgcctcgacgttcggtgacctgaacgtgttcgacaacgcgctgcgggagggggcggacccggcgtcgcggctcatcggcagggcgcaggggatcggggtgcacgcgtcgctggacgaatccggcggcctcaccgccatcgactttgccttctccgactacggcgagtacagcggcagcacgctggcgacgacgggacacttcaccgtgtcagccccatcggagcgcagcatcgtcggcggcaccggcaagctccggttcgcgcgcgggtacctcaccagcaggctcctcagctccacggacacctccatcgtcgtcgtcttcgacatgtacttcaccctggcccactggcactgatagtcgtccagtgcacggacttacttttttgttgttgttgttgttgttgaaattgtgcaagacgtaaactgttccaataaaaaaaaaaaaaaaaaaaaaaaaaaaaaa

SEQ ID NO: 107 - DNA, 1358 bp, Zea mays
cacgcgcgcataccgacggacttggtagctgctcaccagctatccagatcattggctcattgctgcttccattccattcccccttccctcggcatcggccgcgcccgcccgtgtcgggcggaggcggacgcgcgcgggaatgggacgccacgcggcctccggcggcggcgtgcagcagaagctgcgcaagggcctctggtcgcccgaggaagacgagaagctctacaaccacatcattcgctacggggtcgggtgctggagctccgtgcccaagctcgcagggctgcagagatgcggcaagagctgccggcttcggtggatcaactacctacgccccgacctgaagcggggcagcttctcgcagcaggaggaggacgcgatcgtcggcctccaccagatcctggggaacaggtggtcgcagatcgcgtcgcacttgccgggccggacggacaacgagatcaagaacttctggaacagctgcctcaagaagaagctgcgtcagcgcggcatcgacaccagcacccacaagcccgcggtctccgccagcgtgccggcggcatcggagcagccggtgtcgcaggaccgcaagccgttggccgcagccgccgctgatggcggctccgacatgaagcaccagcaggtgttcgacccgttcccgctgaccgacagcttcggcggcggcttcggcgccgcactgtacggccacacgggcggcaagcaggacgcggccgcgttcgtggactacagcagcgtgctggacgtgtcggagaacctgggctacggcggcgagagctccagcaacagcagcaactggaactgcgcgccggaggtgcacaacaatgcgctcgacggcgacgcgccgctgcactgggcctccgagagcaaggccacgcccttcgccggctacggcggcgaggagcaatcactcctcgggcacaggttctcggtgccctgccacggccagcaggagcagagccctccgcgttttgacttcgacatcggccggggcgccgtggtcggcgagttcagcctcgagttcttctgaaggtccagcttgggaatttcagcaatctagataccgcgtagcgcgtatatatatactgtgtattaaaggcatttcacacggaacaacaattgagagatcgtgcttcgttaatttcctctagtcgaccttactccttaacaatgtcttgcgtttcttttgtttttttatgttttatgtatgtctaaaataaaggcatagacatatatatgtaaacacggtgtagtgtaatagctatacattaaggccttgtttggataaagagggattggagtggattgaagagtattttagggattgaaagtaaaattagttc

SEQ ID NO: 108 - DNA, 572 bp, Zea mays
tacggcgcggcgtacccgcggcgggtgcaccaccgcgcggcgtcgagcgcgtcgtaccggcacgaccgggacttcatcggctgcctgcaggggttcgactcgtggtacagcgcgcggcaggagaacccgcacgacctcgtcggcgccgtcgtcggcgggcccaacggcgaggacgtcttcaacgaccaccgcggcgcgtacatgcagactgaggcctgcacgtacaacacggcgcccatggtcggggtcttctccaggctcatgcagctggaggggcagtcgccacgcccggcgccggcgccggcggaggatctttgataggagaggtcgttttccttgaaaggttcccagcgacaagtggtggtgcgaaataaacttttcaaaaaggattttaaaaaaaagtgatattgatcgtttaggctggatgtatacatgatgattctttttgttgattcctagatactaccatatttgtttcatgtctttgcacataacaaaagaatcgaaaagaaggatgtaaatttcaaaaatgaactagatctgttatttggctcaaaaaaaaaaaaaaaaaa

SEQ ID NO: 109 - DNA, 1519 bp, Zea mays
atggcggtgctccactctccggtcggagtgaggagcatcgtgacctccctggtggctttcttcatcctagccagctccgtggtgttcctcctcctcgacagagaagccgggctccaagaagaaccggcgataagagccggcggcggcggcggcgacgaggagtgcagctggtctcgggggcgctgggtgtacgacaacgtgtcccggccgctgtacgacgggctcaagtgcgccttcatcttccccgaggtggcctgtgacaagtatggcaggaaggatgtcatgtaccagcactggagatggcagcctcatggtcatggatgcgacctcccaagattcgatgccatgaagctgcttgaagagctgaggaacaagagactggtgtttgtgggtgactcggtgaacaggaaccaatgggtctctctcgtgtgcatggtggaggcctcgatacctgacgacaggctcaagatgcgcatcttcaatggctcgctcatctccttcaaggcactggagtacaacgcgacgatagatttctactggtcgccgctgctggtggagtctaacagcgacaaccccatcatccaccgggtggagtaccggatcataagggcagacaggatcgagaagcacgccagcgtgtggagggacgccgacgtcatcgtcttcaactcttacctgtggtggaggaagcagaaggatgacatgaggatgaaggaagatggtgacgcaaagctagacgagatggaaatggcggatggtttcgagatagctatcaagaaactgacggaatggcttgcaaagaacattgacaagaacaagactaggatatttttcgcaggatcatcaccaacacattcctgggctagcaactggggcggacaagacaagaacaagtgcctgaacgaaacggagccgatcagctacagacccggcggcgggtacaaggctgcaaccacggactacagcctgatggccatggccaggtcctacttccggcggacgctggagccgagaggcatacgcgtccagatactcaacatcacggagctgtccgactaccgcaaggacgggcatcccacggtgttcaggaggcagttcgttcccctgaccaaggagcagatcgcggacccggccagctacgcggactgcacgcactggtgcctcccaggcgtccccgacgtctggaacgagttcctgtatggctacctcacgcagcagagcaaatgagacgatgcattattacaagaatggccttgttatatgtagtagtgtacagtgcagtacagattgccagctgctccgtttagattattagggatggacctgctgttacatgtagagagagacagacaggagatctgtcttgcccaacattaattctagtatctgtaaatcttgttcttcttgtccaacattaattctaggatctgctgctaaccattttttttggatttatgtaaactgagtgattatctgaaatagaatgatctgagtttgctgttccaaaaaaaaaaaaaaa

SEQ ID NO: 110 - DNA, 812 bp, Zea mays
caacttgcctgttgtactgtaccacgagcagccacatgatgacgctcctcaagacgtacaaccacaacgacaagcagcaccagttctcgcttcccaagaggaacttcgtcacctacgccgtctacgcgctcatcgccgtcgcgctcctctacctgttcgtcgacccggcagctccgcctactgcgggttcgggttcgactgcggcatcatctactaccaagccatcatcactggcggcagcggcgaggccaccctggatacagcagcagcagcagccgccgccgctgtcgtcgtcaatatcttccctacctccttctccttacgaagcatcatcatcgacgatgtcctccaatgatagtgcccagccgctgcggttcgcggcgctggacgtcacggcgctggccaacatgcggccggacggccacccgggcccgtacatgcgcaagaacccgttcgccggcggcggcggcaataacacgggagaccaccgcccggtgcagcacgactgcttgcactggtgcatgccagggccggtcgacaccttcaatcagatactgctccagaccatcctccgcgcgcgctagctctgaaaccacctcttgcattgcatgcatgccttcgtcgtcgtcgtcgtcgtccatgatctgcatcagaaacggataagtttctgatgcatgcatgtcgttgactgtacatatatacgagcagtatatataagtttcttaaacatttacttcaagttttgtttgcaaggttaaccatgcataaatgtaaactacgtacgtacttctaatacattatttagttcttgc

SEQ ID NO: 111 - DNA, 1330 bp, Zea mays
gacctggagaagaggaaggaacagggagcaggggggaagaagaggttgctgcgacggctcaagcctcaaatttttggatccaggcagacaagcagagaaacaccagttggtcaagatgtcagctggtttccagctcggtgtgatcgggtcacttgcactctctgtcgcatcctcagttgccattgtcatctgcaacaaagctctcatcagcacgcttggttttccgttcgccacaacattaacaagctggcatctgatggtgaccttctgcaccctccatgtggcacatcgcttgcatttcttcgagcccaaggcgattgatggacagacggtgatactctttgggttgctgaatggcacgtcaattggccttctcaacctgagcttaggattcaactccattggattctaccagatgacaaaattggcgatcatacctttcactgtgctattggagactatcttcttgaacaaaagattcagcgagagtatcaaactctctcttctggtcttacttcttggagtaggaattgcttcaattactgatctcaagctaaacatgcttggttccatcctttctggcctcgccattgccactacttgtgttggccaaattctcacaaatacaatacagaagaggttgaaggtctcctcaacgcagcttctgtaccaatctgcgccttaccaggcaggaattctgtttgcaactggcccttttgtggatcaacttcttactgaccggagtgtctttgcacacaaatactctgctccagttctgggtttcattgtcctatcttgcttgattgcggtgtctgtgaacttcagtacatttcttgtgatcggaacaacatccccagtgacataccaggtgcttggtcaccttaagacatgtctggttctatcatttggttacactctattacatgatcctttcactctaaggaacatattgggcattctaattgccatatttggtatggcactatactcctacttctctgtaagagagggcaagaagaagtcagcaaatgatgctctaccagtttcacagatggcagataaggaggctgaaccacttttggcaactaaagacaacaacgacaccaagaaagcaaatggtttatctcacgactgctgaggcttttcttgtagtttaggtctagtatgaactgcccttcgaatttaaaggacctggaaagccattcttttcattcttgagttcctttttaggaaacggagcttttaaaatttgtatagaatgcatattttgacattaaaattattatttgattgtattctaaaaaaaaaaaaaaaaaaaaaaaaaaaaaaa

SEQ ID NO: 112 - DNA, 1195 bp, Zea mays
gatctccaaccccttccttccttgcttaggagagagagggaggagaggagaggaggaagaagatggagagggcggccccagtgaggagttcccacacctccacggccggcctactcgcgtggcctcaacccgatggcgccgcgtcgcaggcaccacgtcggcctaaccagccgacggaggaattcaggaaggtggtgttcggggggcaggtcaccgaggaggccgacggtctcaacaagacgaagatgaggacgacggcctccgcacccaagtcgaaggagacaacagggatcggcatgtttaaggccgagagcgccgccgccgccgtcacaactgcatcccgtgatcgccaggctagccagatcactttttctcaggacgggaccattcctcccaggaagccaacttcagttgctggggtggcgaggcagcgcgaacttagccataccgttgagagttcgggggacggtaagatgaagcggcaggtgtccaatgcgaaatccaaggagctcagtggtcacaacatctttgctgatcatgaagatccgagtcccaacaggtcaagcagctctgctgctgctctggcacatgtgaaaaatgcaaatgtgagctccttctcctttggaaaggccgacatggacagcacagtgaaaacagcaaagaagaaagggtccagcaacaagtctactgatctgatgaatggcaaggccatctccgagagggattcagcgcctgcagggaaacagcctctgaaccgcgcgaagccgaaaggattgagtggtagtagcatttttgcagacgggaaggcctcaacaactggtgatcatgcaggccgtcggacccggcagccacctggcggcgacagcagcatcttgctgggctagcgtgcatatggatattgtcctatgccgccacacgggtggttggtccgtccgtctgcggccatgttttcctgatcaggcgatgagtcccatctcagatgatctggttcacttctggcgtgtgtatgggtttgtgtctgtgttggttgtgacatgtccaatggaacaaccctatccctactgcgtgtggtgccgttttgttgtgtagtagtacaacggatgacatgtggtaccgtttcgttgtgtgtacgtggatatacatatgtgtgtttggttattaaatactccctccgtttttaaatagtgctggtttt

SEQ ID NO: 113 - DNA, 1519 bp, Zea mays; identical to SEQ ID NO: 109

SEQ ID NO: 114 - DNA, 1356 bp, Zea mays
ctagccggcgacgatccaagagcgggtgcgtggcgacaggctggtaccctgttgccgtcgcctccgccatgttacgttccaccacctctcctctccactccacccacccaacagctgcccccaccaatcacatcacacccagacacctcctacttatcttgcgcgccaagggccagcgcgcgagcgacctcacttgatccgctcccttcgccgcgacgacgttcctacgcagctgcggtcgacgcgcgcacggcagctcgctcgctagctgatcacgacagctcgctcggctcgaccgaatggcgccgcggctgctggcgtgcttcgggcgcggcgtcgcggcggcgccggacgacgcgactggcgagggccagctggaggcgccccccgctggcccggtgctggtggagctgttcgggtcgcaggggtgcggggcgtcgcccgaggcggacgccgtggcggcgcggctggcgcaggactccgggtccggggacggcgccgtcgtggtgctggcgttccacgtcgactactgggactaccgcgggtggaaggaccccttcgcgtccagcgcctggaccgtgcgccagaaggcctacgtggaggcgctccgcctcgacacgctcttcacgccgcaggtcgtcctgcagggccgcgcgcactgcgtcggcaccgaccaggacgcgctcgcgctggccgtccgcgacgccccgcgctaccccgcgcccgccatcaaggtcacgttccagcggccgagccccgcaacactgcaggcgtcgttcacgggcaccctgcgcagccgcgtggagggcccaggcggcgcgagcgtgctggtggcgctgtacgagagcgggctggtgaccgactgcgggcgcggcgagaacaagggcaagtcgctgctcaacgaccacgtggtgcgccgtctcgagaaggtggccgccgtgcgggagggcgcctcgccgaagaagaccgtgtcgggcaccgtccagttcccgctctgggacggctttcgcgccaccaagtgcggcctcgtgctcttcgtccagaacgccgcgctgcaggtgctcggcgtccagcacttcgacctgcctgacaacgtctgagctcgtgacgcggtggggcgcgcgcgcgttccgcgttggctgcctccctgcggcgggcgtcacattctttgtatcactgtatgtagtacatcactggatggtatttagatggaaaacctgagtattctttatctccacgtatgttcttgttctgcattatggcaatggatcttctgttttgcacactaaacttattgtgtggtaaagtggccgagtgtttgagtgagggggaggtaaatggtctctctggactgtg

SEQ ID NO: 115 - protein, 412 aa, Arabidopsis thaliana
MKIHSCLSAILLFLFFSASSAKQNVRTERISGSAGDVLEDDPVGKLKVYVYELPSKYNKKLLQKDPRCLTHMFAAEIFMHRFLLSSPVRTRNPDEADWFYTPIYPTCDLTPTGLPLPFKSPRMMRSSIQLISSNWPYWNRTEGADHFFVVPHDFGACFHYQEEKAIERGILPLLQRATLVQTFGQRNHVCLDEGSITIPPFAPPQKMQAHFIPPDIPRSIFVYFRGLFYDVNNDPEGGYYARGARAAVWENFKNNPLFDISTDHPTTYYEDMQRAIFCLCPLGWAPWSPRLVEAVVFGCIPVIIADDIVLPFADAIPWEEIGVFVAEKDVPELDTILTSIPTEVILRKQRLLANPSMKRAMLFPQPAQPGDAFHQILNGLARKLPHDKSIYLKTGEKALNWTAGPVADLKPW

SEQ ID NO: 116 - DNA, 1525 bp, Arabidopsis thaliana
attcacgtcttccttctgaataaaataaaccctaaaacctaataccgaagtaaactcgtcaaccactgcgcccatgacctcccaacgatactcttcccttatattcttcctcttccttcttcctttctgcgatccaaaccttcaaacacatctccggtagatatgaaaatccactcttgcctctccgccattcttctgttcctcttcttctctgcttcttccgctaaacaaaatgttcggacagagcgaatttcaggaagtgctggtgatgttttggaggatgatccagtgggaaagcttaaggtttatgtatatgagcttccaagcaagtacaacaagaaattactgcaaaaggatcctcgatgtcttacacacatgtttgctgctgagatttttatgcacaggttccttttatctagtcctgttcgaacgcgtaatcctgatgaagctgattggttttacacgccaatttatcctacttgcgacctcactcctaccggcttgccattaccgtttaaatcgccgcgtatgatgagaagttcgatacaactaatctcatcaaattggccttattggaatcggactgaaggagctgatcacttctttgttgtgccccatgactttggagcttgcttccattatcaggaggaaaaagccattgaaagagggatacttccactactccagcgtgccactttggttcagacatttggtcaaaggaaccatgtctgtttggacgaaggctcgatcactattcctccttttgcacctccacagaagatgcaggcccattttattcctccagatattccacgctctatctttgtctacttccgcggtttattttatgatgttaacaacgaccccgaaggtggatattatgcaagaggtgcaagagcagcggtgtgggagaacttcaagaacaaccctttgtttgacatctcaacagatcacccgacaacatactacgaagacatgcagagagccatcttctgtctatgtcctctaggatgggctccatggagccctaggttagttgaagcagttgtgtttgggtgcattccagttatcatagcagacgacatagtactgcctttcgcagacgccatcccctgggaagaaataggagtctttgttgcggaaaaagacgtccctgaactagacacgatcctaacctcaataccaacagaagtgatcctcagaaaacagagactcctcgcaaatccttcgatgaaacgagccatgcttttccctcaacctgcacaaccaggggatgcattccatcagatacttaacgggctagctcggaagttaccccacgacaaaagcatatacttgaagacaggtgagaaggcactgaactggactgctggtccggttgctgacctgaaaccttggtaaagtcagaaagagaggaatctttttgtatatcttgggtttcacctagagcatacgttgttgcctttctatagcacttcaaaaacattagaagtccaagtcctccgagtggattttttttgtagat

SEQ ID NO: 117 - protein, 415 aa, Arabidopsis thaliana
MKLSSCVLIFLLCNTFSSISAFRLSRSQPTERISGSAGDVLEDDPVGRLKVFVYELPSKYNKKILQKDPRCLNHMFAAEIYMQRFLLSSPVRTLNPEEADWFYVPVYTTCDLTPNGLPLPFKSPRMMRSAIQLIASNWPYWNRTEGADHFFVVPHDFGACFHYQEEKAIGRGILPLLQRATLVQTFGQRNHVCLKEGSITVPPYAPPQKMQSHLIPEKTPRSIFVYFRGLFYDVGNDPEGGYYARGARAAVWENFKDNPLFDISTEHPTTYYEDMQRAIFCLCPLGWAPWSPRLVEAVIFGCIPVIIADDIVLPFADAIPWEDIGVFVDEKDVPYLDTILTSIPPEVILRKQRLLANPSMKQAMLFPQPAQPGDAFHQVLNGLARKLPHERSVYLRPGEKLLNWTAGPVADLKPW

SEQ ID NO: 118 - DNA, 1672 bp, Arabidopsis thaliana
atcttcaaatgaaaatcgctgggctctcgctgtcaacgctgggcgtgagtgagatctaacaatcggtagcgaattttgtaaattttgttccggttttgaagtctcaatctcggggttccggttttagcaactacttcttctgacatttcagctgttctagttgatctttatatactttatatgatctgggattttgaagagtttttagggaggaaccaaaatttctgagagagaaaaatgaagttatcgagctgcgttttgatcttccttctatgtaacacattctcctcgatttctgctttccgtctgagtcggagtcaaccaactgagcgaatttcaggtagtgctggtgatgtgttggaagatgatcccgtgggaagactgaaagtctttgtttatgagcttccaagtaaatacaacaagaagatacttcagaaggatccgagatgtctaaaccacatgtttgctgctgagatatatatgcaacggtttcttttatctagcccagttcgaacacttaatcccgaggaagctgattggttctacgtacctgtgtacaccacttgtgatctcacgcctaatgggcttcctcttccttttaaatctccacgaatgatgagaagtgccattcagcttattgcttccaattggccatactggaatcgcacagaaggagcagaccacttctttgttgtgcctcatgactttggagcctgtttccattatcaagaagagaaggcaataggaagaggaatactacccttgcttcaacgagctacactggtgcagacatttggacaaaggaatcatgtttgcttgaaagaaggttcaatcactgttcctccatatgctccaccacagaagatgcagtcacacttaattcccgaaaaaactcctcgatccatcttcgtttatttcagaggattgttttatgatgtgggaaatgaccctgagggtggttattatgcgaggggtgcaagagcagctgtatgggaaaacttcaaagacaatccgctgtttgacatctcaacagagcacccaacaacatattatgaggacatgcagagagcaatcttctgcctatgcccacttggatgggccccatggagtccaagactggtggaagcagtgatattcggttgcatccctgtgatcatagcagacgacatcgtgttaccttttgcagatgcaatcccttgggaagatattggtgtgtttgtggatgagaaagatgtcccttacctggacacaatactcacatcgatcccaccagaggttatactgagaaaacagaggttgttggcaaacccgtcgatgaaacaagccatgctgttcccgcaaccggctcaaccaggggatgcgtttcatcaagtattgaatgggttggctcgtaagctgcctcatgagaggagtgtgtatctgagaccaggtgagaagctgttgaactggacggcaggaccggtcgctgatctgaaaccttggtaaggaccagtgttggaatttgattgaatgagctattgtttggttggtttctgtcttctcgtgtctgtattttgtagaatcataacttttttttgctatgtagaagggaaaaagctttgtcattgtaatgtaactagaatccttttgacatctcacgagaaagacaagtaaaagaaaaattattgttctc

SEQ ID NO: 119 - protein, 417 aa, Oryza sativa
MRRWVLAIAILAAAVCFFLGAQAQEVRQGHQTERISGSAGDVLEDDPVGRLKVYVYDLPSKYNKKLLKKDPRCLNHMFAAEIFMHRFLLSSAVRTFNPEEADWFYTPVYTTCDLTPSGLPLPFKSPRMMRSAIELIATNWPYWNRSEGADHFFVTPHDFGACFHYQEEKAIGRGILPLLQRATLVQTFGQKNHVCLKDGSITIPPYAPPQKMQAHLIPPDTPRSIFVYFRGLFYDTSNDPEGGYYARGARASVWENFKNNPLFDISTDHPPTYYEDMQRSVFCLCPLGWAPWSPRLVEAVVFGCIPVIIADDIVLPFADAIPWEEIGVFVAEEDVPKLDSILTSIPTDVILRKQRLLANPSMKQAMLFPQPAQAGDAFHQILNGLARKLPHGENVFLKPGERALNWTAGPVGDLKPW

SEQ ID NO: 120 - DNA, 1804 bp, Oryza sativa
cttgaagcctgcttatatgtggagttggaggaagaaggaaggaagcctaggaaagcctcccctcaccttctcaactcaccaaacgcttcttggtaggagaattgccagaaaagtttcccccttctccttggatcctttaattacctcctggcaattgcctgctagctcataaggccggacagggagagggttggagaggagaggagacacaggtgctgggaagaggcctgtggggatcaagaagatgaggaggtgggtcttggccattgccattcttgctgctgctgtatgcttcttccttggagctcaggcccaggaggtgcggcagggccaccagacagagaggatctcaggaagtgctggtgatgtgttggaagatgaccctgttgggaggcttaaggtctatgtctatgatctcccaagcaagtacaacaagaagctgctgaagaaggatcctaggtgcctgaaccacatgtttgccgctgagattttcatgcatcggttcctgttgtcaagcgctgtccgaacttttaatcccgaggaagctgattggttctacacaccggtgtacactacatgcgacctgactccctccggtcttcccttgcccttcaaatccccaagaatgatgcgcagcgcaattgagctgattgcaacaaattggccttactggaatagatcagagggggctgatcatttctttgttacaccacatgactttggcgcttgcttccactatcaggaagaaaaggcaattggacgtggaatcctcccattgcttcagcgtgccaccctggttcagacctttggacaaaagaaccatgtctgcttgaaggacggctcgatcaccattccgccatatgcacccccacagaaaatgcaggctcatcttattcccccagacacccctcggtctatctttgtatatttccgtggtctgttctacgataccagcaatgatcctgagggtggatactatgcaagaggtgcccgcgcgtcggtttgggagaatttcaagaacaacccgctgtttgacatctcaaccgatcacccacccacgtactacgaagatatgcagagatctgtgttctgcttgtgcccattgggctgggctccatggagccccagactggtggaagctgtggttttcggttgtattccggtgatcattgcagatgacattgtcctcccctttgctgatgctatcccctgggaggagattggcgtgtttgtcgccgaggaggatgttccgaagctggacagtatcctgacatccataccaacagatgttatcctgaggaagcagaggcttctcgcgaacccgtcgatgaagcaggccatgctgttcccccagcctgctcaggcaggagatgcattccatcagatactgaatggtctcgctcgcaagcttccacatggcgaaaacgtcttcttgaagcccggggagagggccctgaactggactgctggaccggtgggcgacctgaagccttggtagcatgcatctcactgcctatagaaatgtaaaaacttttttgaaaaagatatatttacagacatgatatatacttgcgccttgagatcaccatggttgcatagtgctgaccataaatcaacaaatgtacatttttttgtatctttttccctgatagctatataccatatatcttcattccttttcttcccattagcggatgaaatgccggcatttgtccgctttgtccatatatgtggataactggatatcataatgaaattatgagatttaattcatgctgaatgcgtgacataatttcaaatgtgg

SEQ ID NO: 121 - protein, 413 aa, Populus trichocarpa
MRVCLWFFVVVIVFGFGDGKNADQRLRTERISGSAGDVLEDNPVGRLKVFVYELPSKYNKKLLQKDPRCLTHMFAAEIFMHRFLLSSPVRTLNPEEADWFYTPIYPTCDLTPTGLPLPFNSPRMMRSAIQLLSSNWPYWNRTEGADHFFVVPHDFGACFHYQEEKAIERGILPLLRRATLVQTFGQRNHVCLNEGSITIPPYAPPQKMQAHQIPLDTPRSIFVYFRGLFYDVNNDPEGGYYARGARAAVWENFKNNPLFDISTDHPTTYYEDMQRAIFCLCPLGWAPWSPRLVEAVVFGCIPVIIADDIVLPFADAIPWEEIGVFVAEEDVPHLDTFLTSIPPEVILRKQRLLANPSMKRAMLFPQPAQPGDAFHQILNGLARKLPHDRTVYLKPGQKVLNWTAGPAGDLKPW

SEQ ID NO: 122 - DNA, 1414 bp, Populus trichocarpa
accctgaacacccatttcggtttttagtcgagattttgggccgggggttggaaaaatgagggtgtgcttgtggttttttgttgtggttattgttttcggttttggtgatggaaaaaatgctgatcaaaggctacgcacagagaggatttcaggaagtgctggggatgtgttggaagataatccagtgggaagattgaaagtctttgtttatgagcttcctagtaaatacaacaagaaattactgcagaaggaccccagatgtctcactcatatgtttgctgctgaaattttcatgcatagatttctcttatccagcccagtccgaacccttaatccagaagaagcagattggttttatacccctatataccccacttgtgacctcacacctactggcttgccgttgcccttcaattctccaaggatgatgagaagtgcaatacagcttctctcctccaattggccttactggaatcgtacagaaggggctgatcacttctttgttgtgccccatgactttggagcctgcttccactatcaggaagagaaagccattgagcggggcattcttccactactccggcgtgctactttagttcaaacttttgggcagcgaaaccatgtgtgcttgaatgaggggtcaattacaattcctccgtatgctcctcctcaaaagatgcaggcccaccagattccccttgacactccgcggtcaatttttgtttacttccgcggattgttttatgatgtaaataatgatccggaaggtggttattatgcaagaggagcaagggctgcagtttgggagaatttcaaaaacaatccactctttgacatctccaccgatcatccaacaacatattatgaagacatgcaacgagctatattttgcttgtgcccactcggttgggccccatggagtcctagactggtcgaagcagtggtattcggatgcattcctgtaattatagcagatgatattgttttaccatttgccgatgctatcccatgggaggagattggagtgtttgtagcagaggaagatgtccctcacctggacacattcctgacatctataccaccagaagtgattttaaggaaacaaaggcttcttgcaaacccttccatgaaacgtgcaatgttattcccacaacctgcacaacctggtgatgctttccaccaaatactgaatgggttggctcgtaagttgccgcatgacaggactgtttacttgaaacctggtcagaaggttttgaattggacagcaggaccagctggggacctgaaaccttggtaagagaagtgtctttttctcaaaagagattgttgtagtgtatctgctgtttcatctaatcacatgtacatctgggacatagttcgatgcattaaatagcttcatattttcccggacaca

SEQ ID NO: 123 - protein, 412 aa, Populus trichocarpa
MRTCLWVFAVVLVFGFVDGKEIERLRTERISGSAGDVLDDDPVGRLKVYVYELPSKYNKKLLQKDPRCLTHMFAAEIFMHRFLLSSPVRTLNPDEADWFYSPIYPTCDLTPMGLPLPFKSPRMMRSAIQLISSNWPYWNRTEGADHFFVVPHDFGACFHYQEEKAIERGILPLLQRSTLVQTFGQRNHVCLNEGSITIPPFAPPQKMQAHQIPPDIPRSIFVYFRGLFYDVNNDPEGGYYARGARAAVWENFKNNPLFDISTDHPTTYYEDMQRAIFCLCPLGWAPWSPRLVEAVVFGCIPVIIADDIVLPFADAIPWEEIGVFVAEEDVPNLDTILTSIPPEVILRKQRLLANPSMKRAMLFPQPAQPGDAFHQILNGLARKLPHDRSVYLKSGQNILNWTAGPVGDLKPW

SEQ ID NO: 124 - DNA, 1464 bp, Populus trichocarpa
caccctgaagccccatttcggtttttagtcgaaatcttgggttgggggctggaaatatgaggacatgcttgtgggtttttgccgtggttcttgttttcggttttgttgatggaaaagaaattgaaaggttgcgcacggagaggatttcaggaagcgctggggatgtgttggatgatgatccagtgggaaggttgaaggtctatgtttatgagcttccgagtaaatacaacaagaaactgctgcagaaggaccccagatgtctcacccatatgtttgctgctgaaatcttcatgcatagatttctcttatccagcccagttcgaacccttaatccagatgaagcagattggttttattcccctatataccccacttgtgatctcacacccatgggcttgccgttgcccttcaaatctcctaggatgatgagaagtgcgatacagctaatctcctccaattggccttactggaatcgtacggaaggggctgatcacttttttgttgtgccccatgactttggagcctgcttccactatcaggaagagaaagccattgagcggggcattctcccgttactccagcgttctactttggttcaaacttttgggcaacgaaatcatgtgtgcttgaatgaggggtcaattacaattcctccttttgctcctcctcaaaagatgcaggcccaccagattccccctgacattccacggtccatttttgtctatttccgtggattgttttatgatgtaaataatgatccagaaggtggttattatgcaagaggagcaagggctgcagtttgggagaatttcaagaacaatccactcttcgacatctccactgaccatccaacaacatattatgaagacatgcagcgagctatattttgcttgtgcccgctcggttgggccccgtggagtcctagattagttgaagcagtggtatttggatgcattcctgtcatcatagcagatgatattgttttgccatttgccgatgctatcccatgggaggaaattggggtgtttgtagcagaggaagatgtccctaacctggacacaatcctaacatctataccaccagaagtgattttaaggaaacaaaggcttcttgcaaatccttctatgaaacgtgcaatgttattcccacaacctgcacaaccaggtgatgctttccaccaaatactaaacgggctggctcgtaagttgccgcacgacaggagtgtttacttgaagtctggtcaaaatattttgaattggacagcaggaccagttggggacctgaaaccttggtaagagaagtgtcatttcctcaacagacatggctgtggtgtatccactgtttcatctaatcgcaaggactgtaaacttctctttgaagttttgatttttgtatagattcttgaatttcacatgtacatctgggacatagttcgatgctttaaataacttcgcatttttcttg

SEQ ID NO: 125 - protein, 424 aa, Arabidopsis thaliana
MQPSRTRVSFFETGETMKQRKKSYLSIFVIFFSLFFFGIFMYNDNLKSSIADFTSSNPFSSSFVELPPDECDLFTGQWVFDNKTYPLYKEEECEFLTEQVTCLRNGRKDSLFQNWRWQPRDCSLPKFNARVLLEKLRNKRLMFVGDSLNRNQWESMVCLVQSVIPPGRKSLNQTGSLTVFKIQDYNATVEFYWAPFLVESNSDDPEKHSIIDRIIMPESIEKHGVNWIGVDFLVFNSYIWWMNTVSIKVLRGSFDDGDTEYDEIKRPIAYERVLRTLGDWVDHNIDPLSTTVFFMSMSPLHIKSSDWANPEGIRCALETTPILNMSFNVAYGQFSAVGTDYRLFPVAENVTQSLKVPIHFLNITALSEYRKDAHTSVYTIKQGKLLTREQQNDPANFADCIHWCLPGLPDTWNEFLYTHIISRR

SEQ ID NO: 126 - DNA, 1446 bp, Arabidopsis thaliana
atctctctgagccacatgccgacacttacataactgttgaccaagtctctcttccttctttatcaaatcatgcaaccttcaagaacaagagtttcattttttgaaacaggagagaccatgaagcaaagaaagaagagttatctctcaatcttcgtgatcttcttctctcttttcttcttcgggatcttcatgtacaatgacaacctcaaatcctccattgctgacttcacatcttcgaacccattctctagttcatttgtggagttgccgccggatgagtgtgatctgttcaccggtcaatgggttttcgacaacaagacatatccattgtataaagaagaagagtgtgagttcttgacggagcaagtgacttgtttaagaaacggaaggaaagattctttgtttcagaattggagatggcaacctagagactgttctttaccaaaattcaatgcaagagtgttgttagagaagctgaggaacaagagattgatgtttgtcggtgactcgttaaaccggaaccaatgggaatcaatggtttgtttggttcaatcagtgattcctcccggtagaaaaagcttaaaccagaccggttcactcactgttttcaaaatccaggactataacgcgacggtggagttttattgggcgccatttttggtggaatcaaattcagacgatccggaaaagcacagtataatcgaccgtataataatgccagagtccatcgagaagcatggagtcaactggataggcgttgactttcttgtcttcaatagttacatctggtggatgaatactgtctccatcaaagtcctacgtggatcgttcgatgatggggacacagagtatgatgagatcaaacggccaatagcgtacgagagggtgttgaggacattgggagattgggtggaccataacattgatcctctaagtacaactgttttcttcatgagcatgtctcctcttcacatcaagagctcagattgggctaatcctgagggtataaggtgtgctttagagacaacaccgatcttgaacatgtctttcaacgtggcttacgggcagttttccgcggtggggacggattacaggctgtttccggtggcggaaaacgttacacagtctctaaaagttcctattcatttcctcaacattactgcattgtctgagtatcgtaaagatgcacatacttcggtttacacgatcaagcaaggcaagttgctgacgcgggagcagcaaaacgatccagccaattttgctgattgcatacactggtgcttaccaggccttcctgatacatggaatgagtttctctatacacatattatttctcgaagatgagattctttcatcctcttttttggtttaaaaaaattcttgtgatgtatataggacagagattcaagggatttgaagttagccaagtaaggctaaaaatttgtt

SEQ ID NO: 127 - protein, 487 aa, Arabidopsis thaliana
MQPWRRKFPLFETGVTMKQRKNSNLSIFVVVFSVFLFGIFMYNEDVKSIAEFPFSTSKPHDVHDEATPITEITTLPVQESIKNSDPIQESIKNADSVQDSVKDVAEPVQEEVSKTEEVKKIELFAATEDEEDVELPPEECDLFTGEWVFDNETHPLYKEDQCEFLTAQVTCMRNGRRDSLYQNWRWQPRDCSLPKFKAKLLLEKLRNKRMMFVGDSLNRNQWESMVCLVQSVVPPGRKSLNKTGSLSVFRVEDYNATVEFYWAPFLVESNSDDPNMHSILNRIIMPESIEKHGVNWKGVDFLVFNTYIWWMNTFAMKVLRGSFDKGDTEYEEIERPVAYRRVMRTWGDWVERNIDPLRTTVFFASMSPLHIKSLDWENPDGIKCALETTPILNMSMPFSVGTDYRLFSVAENVTHSLNVPVYFLNITKLSEYRKDAHTSVHTIRQGKMLTPEQQADPNTYADCIHWCLPGLPDTWNEFLYTRIISRS

SEQ ID NO: 128 - DNA, 1861 bp, Arabidopsis thaliana
gacattttagagagcctcgacagagaattatttttttcttttttattttcgtttacaagtttcaattcttctctatatattaaaaaaacaaacagatgcaaccttggagaagaaaatttccattgttcgaaacaggagttacaatgaaacagaggaagaacagtaatctctcaatcttcgtcgtagtcttctctgttttcctcttcgggatcttcatgtacaatgaagacgtcaagtccatcgcagagtttcctttctccacctcaaaacctcacgacgtccacgacgaagcgacaccgatcacagagatcacaacactaccggttcaagagtcgatcaagaactcagacccaattcaggaatcgatcaaaaacgcagactcagttcaagattcagttaaagacgtagcagaaccagttcaagaggaggtatcgaaaacagaggaagttaaaaagattgagcttttcgctgcgacggaggatgaagaagacgtggaattgccgccggaggaatgcgatttgttcaccggagaatgggtttttgataacgagacgcatccattgtataaagaggatcaatgtgagttcttgacggcgcaagtcacttgcatgagaaatggaagaagagattctctgtatcagaactggagatggcaacctagagattgttctttaccaaagttcaaagcgaaattgctgttggagaagctaaggaacaagagaatgatgttcgttggagattccctaaaccggaaccaatgggaatcaatggtttgtttggttcaatcagtggttcctcccggtcgaaaaagcttgaacaaaaccggttctctctccgtcttccgagtcgaggattataatgcgacggtggagttttattgggcaccatttttggtggaatcgaattcagatgatccaaatatgcatagtatacttaaccgtataataatgcctgagtccattgaaaagcatggagtcaactggaaaggcgttgactttcttgttttcaacacttacatttggtggatgaacacattcgctatgaaagtcctacgaggatcgttcgataaaggagacaccgagtatgaggagatcgaacggccagtagcgtataggagagtgatgaggacttggggagattgggtggaacgaaatattgatcctctacgtaccactgtcttctttgctagcatgtctcctcttcacatcaagagcttggattgggagaatccagatgggatcaagtgtgcattagagacgacaccaatcctaaacatgtcaatgccattcagcgtaggaacagactacagactgttttcagtagcggaaaacgtcacgcattctcttaatgttccggtttactttctcaacattaccaaactctccgaataccggaaagatgctcacacttcggttcacacaatccgacaaggcaaaatgctgacgccggagcaacaagccgatcccaacacttacgccgattgtatccattggtgtcttcccggtttacctgacacgtggaatgagttcctttacacacgtatcatttcccgttcgtgacctacaaaatatttgaaatatctctttttcaatattttttcccactttgctccatccaatggaagagccttgaaattttattattttgatgtcctaatgttcataatttttcttgaattgtaattgtgaaatgtttctttctttttctttaatggttattagagtgcctagtaggctattttaactgtttttgtactcttaaaactttgaaatgaggtggataacaaaggatgccaaatgttttttttttgttcaatgaagtgggtaaaacttgctcacattcgactgtttcttttaacggt

SEQ ID NO: 129 - protein, 203 aa, Medicago truncatula
MPESIEKHGVHWKNVDYLIFNTYIWWMNTGTMKVLRGSFDEGSKEYDEVPRPIAYRRVLETWSRFVDNNIDPNRTKVFFNSMSPLHIKSEDWNNPNGIKCAKETTPILNMSTPVQVGTDHRLFVIAKNVTKSTKVKVDFIYITKLSEYRKDAHTSVYTIRQGKVLTPEQQANPATYADCIHWCLPGLPDTWNELLYTRIVSLS

SEQ ID NO: 130 - DNA, 612 bp, Medicago truncatula
atgcctgaatcaattgaaaagcatggtgtgcattggaaaaatgtggactaccttatttttaacacatacatatggtggatgaatactggcacgatgaaagtcctgcgagggtcgtttgatgaaggatccaaggagtacgatgaagtccctagaccgatagcatataggagagtccttgagacatggtcaagatttgtagataataacattgatccaaatcgcaccaaagttttcttcaacagcatgtcccctcttcatatcaagagcgaggattggaacaatccaaatggaataaaatgtgcaaaggaaactacaccaattctcaacatgtctactccagtacaagtaggcacagatcatcgtctttttgtcattgctaaaaatgtgacaaaatcaacaaaagtgaaagtggattttatatacatcaccaaattatcagaatatagaaaagatgcacatacttctgtttacacaatacgtcaaggcaaagtgttaactccagagcaacaagctaaccctgctacttatgcagattgtatccattggtgtttaccagggttacctgatacatggaatgagttgctttatacacgtatcgtctctctttcttga

SEQ ID NO: 131 - protein, 558 aa, Oryza sativa
MQQRRKSVFASAPFAMKQAALGAGVAARRNGAPLSLAAVVFALFVFATFLYNEDIKSIADFPFGAGALRAKSPDLHVLQETVGAAHLAAGSIAKRGEEVIVRVLDAPASTAMAAAAGSSSNNSTIEVAKANANANANAADAGVKVDEGQERERDVTLPSVKEGGADEARRREDEEAAEKESSAKAAAATAALRTVVSVPDTCDLYRGNWVYDEVNAPVYKESQCEFLTEQVTCMRNGRRDDSYQKWRWQPTDCDLPRFDARLLLERLRNKRLMFVGDSLNRNQWESMVCLVQSVIPKGKKTLTKFVNGGNSNIFYAHEYNATVEFYWAPFLVESNSDNPQVHSVPDRVIQWHSIAKHAHNWLGVDYLIFNTYIWWLNTLDMKVLKGSFDQGATEYVEVDRPVAYKEVLKTWAKWVDRNIDPNRTTVFFMSMSPNHITPEAWGNYGGIKCAMETLPITNRTTSLDVGTDWRLYAGAQEVLQTFRRVPVHLVDITALSELRKDAHTSVHTLRQGKLLTPEQQSDPKTYADCIHWCLPGLPDTWNQFLYARIASAPWSSDQ

SEQ ID NO: 132 - DNA, 2866 bp, Oryza sativa
gaaaacgaaatgtatgatatagtaggcatataattaaaacatgcaacgaacaaatagaatactagtagtagaatacacacacgcacattgcctgtgttgttacatgtgtacaacagcttaacctccaaaccccccatggaagctttgcagccttgcatgttactcatttgacccacccctcagtagtagtactaccctctatctctctatatacaaaatgaaagggaatgagattcaattaagcagctagaacaggggggagtttacaagtgttggtggaggggaagagatcttgcaaccataaaagaagaaagcaggcgaaccaaaccaaacataccaaagggaagcaaagaaaagggcaaacatccagcaaaagtcaccaaacttgtaaagggatcgacacatatataggagagcgaggtgtccagtcgagaaggacagccaggccaaggagctcctagcctcctagcctacacagagctaagcaaagaggcaaagagctcagcaagaagctccattaatccattccatatactcatatagagaggaggaggaggaggaagaggaagagaggggaagcaaagcaagaagctttttttacttctcgggtttgcaagccaccgggaaaggccggggcttggtggtggtggtggtggtaagttttctttaaagcggcggagcgggaggccttcctgggcgctccggagatgcagcagcggcggaagtcggtgttcgcctcggcgccgttcgcgatgaagcaggcggcgctgggggccggcgtggcggcgcgcaggaacggcgcgccgctgtcgctggcggcggtggtgttcgcgctcttcgtgttcgcgacgttcctctacaacgaggacatcaagtccatcgccgacttccccttcggcgccggcgcgctccgcgccaagtcccccgacctccacgtcctccaggagaccgtgggcgccgcgcacctcgccgccggcagcatcgccaagcgcggcgaggaggtcatcgtccgtgtcctcgacgcgcccgcctccacggcgatggcggccgccgccggcagcagcagcaacaacagcacgattgaggtggccaaggccaatgccaacgccaacgccaacgccgccgacgccggtgtcaaggtggacgaggggcaggagagggagcgggacgtgacgctcccgagtgtcaaggaaggcggcgccgacgaggcgaggcggcgggaggacgaggaggccgccgagaaggagtcctcggcgaaggccgccgcggcgacggcggcgctgcggaccgtggtgagcgtgccggacacctgcgacctgtaccgcggcaactgggtgtacgacgaggtgaacgcgccggtgtacaaggagtcgcagtgcgagttcctgacggagcaggtcacctgcatgcgcaacggccgccgcgacgactcctaccagaagtggcgctggcagccgaccgactgcgacctgccccggttcgacgcgaggctgctgctggagcggctgcgcaacaagcggctgatgttcgtgggggattcgctgaaccgcaaccagtgggagtcgatggtgtgcctggtccagtccgtgatccccaagggcaagaagacgctcaccaagttcgtcaacggcggcaacagcaacatcttctacgcacacgagtacaacgcgacggtggagttctactgggcgccgttcctggtggagtcgaactcggacaacccgcaggtgcacagcgtccccgaccgcgtcatccagtggcactccatcgccaagcacgcgcacaactggctcggcgtcgactacctcatcttcaacacctacatctggtggctcaacaccctcgacatgaaagtcctgaaggggtcgttcgaccagggtgcgacggagtacgtggaggtggaccggcccgtggcgtacaaggaggtgctcaagacgtgggcgaagtgggtcgaccgcaacattgaccccaaccggacgaccgtcttcttcatgagcatgtctcccaaccacatcacgccggaggcgtggggaaactacggagggatcaagtgcgcgatggagacgctgccgatcacgaaccggacgacgtcgctggacgtgggcacggactggaggctgtacgccggggcgcaggaggtgctccagacgttccgccgggtgccggtgcacctcgtcgacatcacggcgctgtcggagctccgcaaggatgcgcacacgtcggtgcacacgctccggcaggggaagctgctcacccccgagcagcagtccgaccccaagacgtacgccgactgcatccactggtgcctcccgggcctccccgacacctggaaccagttcctctacgcccgcatcgcctccgccccatggtcatccgaccagtagaaaaagagccaaataaggctagcttccaagtgttctgcgagacaagaaaaggagccaagaacaccgttgacacaccatcgatgcccgccgcccggccgcggccacctcactttttcttactttgggttacttttttttcttctctttttttcaccatttttctttctttctctggggttgcgtaaagctgtcttgtgctgtgtttaacatgtgattcttttgttaaaaaagaaatggagggtttaggatggtgaaggaggatctgtgggcgggctgtgttgactatagctcatttcttgtcctgctgataaaggatgcatggataggagaaagcaaaaaaagggtgtgatgtgagatgtaaggggggaaagaaaaagggagggttacatgtaaagaatttttgtgtattacaccattctagtacattgatgctcaagagaggtataaaggccacgaggtgcatccgttcttcaattatgatg

SEQ ID NO: 133 - protein, 459 aa, Populus trichocarpa
MQPSRRKSPLLSSVTVTMKHRKNSNLSVFVVVFSVFLFGVFMYNEDVKSIAEFPFSWPKSQEEPSKGVTPGPGEVQESDNLKSSESKEDEEKIEFPVIEEDDEDVELPPEECDLFTGQWVFDNETRPLYKEDECEFLTAQVTCMRNGRKDSLYQNWKWQPRDCSLPKFKPRLLLNKLRNKRLMFVGDSLNRNQWESMVCFVQSLIPPGRKSLNKTGSLAVFRIEDYNATVEFYWAPFLVESNSDDPNMHSILNRIIMPESIDKHGVNWKNVDYLVFNTYIWWMNTFKMKVLRGSFDEGSTEYDEIERPVAYRRVLTTWSKWVEKNVDTNRTTVFFSSMSPLHIKSLDWENPDGIKCAKETAPILDVSMKFNLGTDRRLFAVAANITGSMKVPVHFINITKLSEYRKDAHTSVYTIRQGKMLTPEQQADPATYADCIHWCLPGLPDTWNEFLYTRIISRT

SEQ ID NO: 134 - DNA, 1867 bp, Populus trichocarpa
atgcagccatcaagaaggaagtcacctctcctctcctcggtaaccgtaaccatgaagcacaggaagaacagcaatctctcggtatttgttgtcgtgttctctgtatttctcttcggtgtcttcatgtacaatgaggacgtgaaatccattgctgagttccccttttcatggcctaaatctcaagaagagccatcaaaaggagtcaccccaggccctggagaagttcaagaatctgacaacttgaagtctagtgaatcaaaagaggacgaggaaaagattgaatttccagtcattgaagaggatgatgaagacgttgaattgccaccagaagagtgtgatcttttcacgggacaatgggtttttgacaatgagactcgtcctctgtataaagaagatgaatgtgagttccttacagcacaagtgacttgcatgaggaatggaagaaaggattctttgtatcagaattggaaatggcaacctagagattgttctttgccgaagttcaagccaaggctactgctaaacaagttaaggaataagaggcttatgtttgttggggattcattgaataggaatcaatgggaatcaatggtttgttttgttcaatctctaatccctcctggaaggaagagtctgaacaagactggatctttagctgtgttcagaatcgaggactataatgcgacagtggagttctattgggccccatttctggttgagtcaaattcagacgatccaaacatgcacagcatcttgaataggataatcatgcctgaatcaattgataaacatggtgttaattggaagaatgtcgactacctggtttttaacacatacatttggtggatgaacactttcaaaatgaaagttctacgtggctcgtttgatgaaggatccaccgagtatgatgagatcgaacggccagtagcgtataggagagttttgactacatggtccaagtgggtggagaaaaatgtggataccaatcgtaccactgtcttcttcagcagcatgtctcctcttcatatcaagagcttggactgggagaatccggatggcataaaatgtgccaaggagacagccccgattctggatgtaagcatgaaatttaatttgggcacggaccgcaggctttttgcggttgcagccaacattactggatccatgaaagtacctgtccattttatcaacattactaagctttcagagtacagaaaagatgcacatacttcagtctacactatccgtcaaggcaaaatgctaacaccggagcagcaggctgacccagcgacgtacgccgattgtattcattggtgtctgccagggttgcccgacacgtggaatgaattcctttacacacgtataatttctcgcacgtgacccctagggataggaattaacacgtgcgaggcctttttttttgtttttttttcccaccctcctcgacattgttttgtttttcctctgtaatttctcctcgtctcatcttttaagcttctcagagcttcaattataggtctgagccgtcgtcaacattgttttggaactttgttccgctttatttgacagggggggttaggcatgagaaaatcccggtgatcggattcttcattggtaacattatactactctttttatattataatgcccgtccggtttttcctggaacttgtacaagtcattacgagaggctcggcctaagagctatatcgtgccctaccctcggaggaaaaggaggttgggttccaggcgagcatatgcccaattaagtttaaaaatgaacaacacatgatacacgtttgaattgtacaatgcacaattgcacatgtgaaaataaataaagaacaagtacaaatttgtatgtaaa

SEQ ID NO: 135 - protein, 473 aa, Populus trichocarpa
MKHRKNNNLSVFVVVSSIFIFGVFMYNEDVKSIAEFPFSWPKSQEIQEELSKGTTPVQETLKKDRELPASVGSRTSLEEPQVDQEFEENQESDKLKSSGSKEDEEKIELPIIEEDDVDVELPPEECDLFTGEWVFDNETRPLYKEDECEFLTAQVTCMRNGRKDSLYQNWKWQPRDCSLPKFKPRLLLNKLRNKRLMFVGDSLNRNQWESMICFVQSVIPPGRKSLNKTGSLAVFRIEDYNATVEFYWAPFLVESNSDDPNMHSILNRIIMPESIDKHGVDWKNVDYLIFNTYIWWMNTFSMKVLRGSFDEGSTEYDEIERPVAYRRVLNTWSKWVEKNVDPNRTTVFFSSMSPLHIKSLDWENPDGIKCAKETAPILNVSMPLNVGTDRRLFVVAANITGSMKVPVHFLNITKLSEYRKDAHTSVHTIRQGKMLTPEQQADPETYADCIHWCLPGLPDTWNEFIYTRIISRT

SEQ ID NO: 136 - DNA, 1798 bp, Populus trichocarpa
accattctactcatgcagacatcaaggaggaagtcgcctctcctctcttcagtaaccatagccatgaaacacaggaagaacaacaatctctctgtatttgttgtggtatcctctatctttatcttcggagtcttcatgtacaatgaggacgtgaagtcaattgccgagttcccattttcatggcctaaatctcaagaaatccaagaagagctatcaaaaggaaccaccccagttcaagaaaccctcaagaaggaccgagaactcccagcttcggttggttcaagaacttcactggaagaacctcaagttgatcaggagtttgaagagaatcaagaatctgataaattgaagtctagtggatcaaaagaagatgaggaaaagattgaattgccaatcatcgaagaagatgatgttgatgttgaattgccaccagaagagtgtgatcttttcacaggagaatgggtttttgacaacgagacacgccctttgtataaagaggatgaatgtgagttccttacagcacaagtgacttgcatgaggaatggaagaaaggattctttgtaccagaattggaaatggcaacctagagattgttctttgccaaagttcaagccaaggctactgctaaacaagttaaggaataagaggcttatgtttgttggggattcgttgaataggaatcagtgggaatcaatgatttgttttgttcaatccgtaatccctcctggaagaaagagtttgaacaagactggatctttagctgtgttcagaatcgaggactataatgcaacagtggagttctattgggccccgtttttggtcgagtcaaactccgacgatccaaatatgcacagcatcttgaacagaataatcatgcctgaatcaattgataagcatggtgtcgactggaagaatgtcgactacctgatttttaacacatacatctggtggatgaacactttcagcatgaaagttctacgtggatcgtttgatgaagggtccaccgagtatgacgagatcgaacggccagtagcgtacaggagagttttaaatacgtggtcgaagtgggtggagaaaaatgtggatcccaatcgtaccaccgtcttcttcagtagcatgtctcctcttcatatcaagagcttggactgggagaacccggatggcataaaatgtgccaaggagacagccccaattctgaatgtaagcatgccattgaatgtgggcacggaccgtaggctctttgtggttgcagctaatattactggatcgatgaaagtgcctgtccattttctcaacattactaaactttccgagtacagaaaagatgcacatacttcagtccacaccatccgtcagggcaaaatgctaaccccggagcagcaggctgacccggaaacatatgccgactgtatccactggtgtctgcccgggttgcctgacacgtggaatgaattcatttacacacgtataatttctcgcacgtgacccctaggaattaacacgtgcaatgttttgttttctactttgtaatttctcctggtttcctctttttttttagcctctcatagcttgaattataggtccggaccgtcatcaacattgttctggaaatttgttctgcttcatttgacagatgtgggagagggagatgattaggcatgccaaatcccgagtaattagagcaaagcatgccaaattaagtttaaaaacggacagcttgataaacccatttgaattgtataatgaacatgtgggtcgtgggaagagaataaagaacaaatacaaacttgtatgtgaa

SEQ ID NO: 137 - protein, 371 aa, Oryza sativa
MGTAAVAAAERPKQRRSSHLWKKALLHFSLCFVMGFFTGFAPSSSSSWRAGSGGGGGVQPRHQLAASHVAVNQQVSLVPDAAAAEAAGVGNGAVVDVGDDEGGEGARRMLIVVTTTRGERRRRRGELLRLAHTLRLVRPPVVWVVVEPAADAAATAEVLRGTGVMYRHLAFRPEENFTTADAEAHAQRNAALAHVEKHRLSGVVHFADAAGVYDAHFFDEIRQIEAFGTWPVATMSAGEKKVVVEGPLCSDSKVVGWFSRDFNDGTTRAVTYNTEADLNPAGAAGTRAHTIDVSGFAFNSSILWDPERWGRPTSLPDTSQDSIKFVQEVVLEDRTKLKGIPSDCSQIMVWQYTMPMQVHAQTSTPKTHNRR

SEQ ID NO: 138 - DNA, 2286 bp, Oryza sativa
cattttcttcttactaccatttcaattcaaccatgaatgaaaaatgtgaaaatttttgtgtcggtgaggtgtgtgatttagcaggagagagagagagagagatttggttgatttgtttgcaagaaagaaaagcaaaaaaattgtggggtgttgtggccgttgatggacaggcaagtttcaccacactcctcccgccttctttaaaccctcctcaccaaccatctcatctctctcaccatttcattttatttttcatttttcaccacaaatttttcaccattccaagcaccacaaaaaccttgttcctcctcctcatctctctccatttctccccatatcttgattgagcttgttgagattccccatgcacattcctccctccatttccaccaccaccccaaatcttgttgggtgatctatctatctatcatcttcttgtaggagtactagtggagtttgttgatcttcacccccaccaccattaatggctgcaaagcttcactagaggaggaggactagtagtataccatcttcttcttcttctagcttgatctggtgctccattggtggtgttggtgcatcttgatctgggattctggggagaggttgagtgaatctttgggcctccatggggacggcggcggtggcggcggcggagaggccgaagcagcggcggagcagccacctgtggaagaaggcgctgctccacttctccctctgcttcgtcatgggcttcttcaccggcttcgcgccctcgtcgtcgtcgtcgtggcgggccgggagcggtggcggtggcggtgtccagccgcgccaccagctcgcggcgtcccacgtcgcggtgaaccagcaggtgagcctggtgccggatgcggcggcggcggaggcggccggggtcgggaacggcgcggtggtggacgtgggcgacgacgaggggggcgagggggcgaggcggatgctgatagtggtgacgacgacgcggggggagcggcggcggcggcgcggcgagctgctgcggctggcgcacacgctgaggctggtgaggccgccggtggtgtgggtggtggtggagcccgcggcggacgcggcggcgacggcggaggtgctgcgcggcacgggggtgatgtaccggcacctcgcgttccggcccgaggagaacttcaccaccgccgacgccgaggcgcacgcgcagcgcaacgccgcgctcgcccacgtcgagaagcaccgcctctccggcgtcgtccacttcgccgacgccgccggcgtctacgacgcccatttcttcgacgagatccgccagatcgaggcatttggcacatggccagtggcaacaatgtcggcaggcgagaagaaagtggtagtcgagggcccgctatgcagtgactccaaggttgtcggttggttctcgagggacttcaatgatgggaccacccgtgcagtgacatataacacagaggcggacttgaatcctgctggtgctgctggcacgcgagctcacacgattgacgtctcagggtttgcgttcaacagttctattttgtgggatcccgagcgttggggcaggccgacgtcattaccagacacttcacaggattccatcaagtttgtgcaagaggttgtattggaagacaggaccaagctaaaggggattccctcagattgctcccaaatcatggtttggcaatatactatgcccatgcaagttcatgcccaaacctctactccaaaaactcacaatagaaggtagggagagaacaagcaagaggattctccagaaagggaaaaaagtgggaagttgatgtaaatgtggtgaaaacaaaagaaaaggaagaaggttgtttacactgagtttttttccctttctttttctctcatttttgttttctttttagtttggggggccatgaattgtctgcggaaaatctccccccaagcaatagtatttattcagattcacttgtgattctttaactctgctcctctcatcttcatctcatctcatctcctgggtaatcttttgtgagggggatgttgcttcaaacaaattccccttgtggattgcaataatacactgtagaaatgtgggtgaaaatttggcaatgccatgagaattcagaagattaaggccttctcagaaagaaaaaaaaagagcacataatctccttgctgtatattctgacattgttttcactcttattctggcattgtaaaagcagaattaaggttggtgattactgtctcggatactacttactgctttcgtcataaaataaataattctagtacgtg

SEQ ID NO: 139 - protein, 322 aa, Arabidopsis thaliana
MKNGSGNTNTKLILLHPYIQKQTSTTRLWLLAFVSFFTIVFLLTLLYTRDTIPSKNTSVAAAVAAVVTGGSTPSASSPISNSNLPTSAINALLHYASRSNDSFHMSYGEMKSISDVLRRCAPPCNLLVFGLTHETLLWKSLNHNGRTVFIEENRYYAAYFEEIHPEIDVFDVQYTTKAHEAGELVTAAKEAAGNECRPVQNLLFSDCKLGLNDLPNHVYDVDWDVIFVDGPRGDAHEGPGRMSSIFTAAVLARSKKGGTPKTHVFVHDYYRDVERLCGDEFLCRENLVESNDLLAHYVLDKMDKNSTKFCNGRKKRSVSSLS

SEQ ID NO: 140 - DNA, 1306 bp, Arabidopsis thaliana
atcttataaccatccttcaatctccttcttcctctaaaactcttctaaagaagaaaacagaggaacgagaagaagaagaagagtgaacaatgaagaacggatcagggaacacgaacacaaaactaatccttcttcatccttacatccaaaaacaaacgagcacgactcgtttatggcttctcgctttcgtctctttcttcaccatagtttttctcctcactcttctctacactagagacacaatcccttccaaaaacacctccgtcgccgcagccgtagctgcagtcgtcaccggaggatccacaccttcagcatcatctcccatctccaactccaacttaccaactagtgcaatcaacgctttgcttcactacgcgtcaagatccaacgatagtttccacatgtcttacggagagatgaaatcaatctctgacgtcctccgccgctgcgctccaccgtgtaatcttctcgttttcggactcacacacgagactctcctttggaagtcgttaaaccacaacggtagaacagtgttcatcgaggagaatcgttactacgcggcttacttcgaagaaatccacccggagatcgacgttttcgacgttcaatacacgacaaaagctcacgaagctggagagctcgtcaccgcggctaaagaagccgcgggaaacgagtgtcgtcctgtgcaaaatcttctcttctcagattgtaaattaggtctcaatgatttgcctaatcatgtctacgatgttgattgggatgtaatctttgtggacgggccacgtggcgatgctcacgaaggaccggggaggatgtcgtcgattttcacggcggcggttcttgctcggagcaaaaagggcgggactccgaagacgcatgtgtttgtgcatgactattatagagacgttgagaggctttgtggtgatgagttcttgtgccgagagaatcttgttgagtctaatgatttgcttgcacactacgtgttggataagatggataaaaacagcacaaagttttgcaatggtcgtaagaaacgttcggtttcgtctttgtcttaaaagtgatgccagaagacttcatacgtacatttgcttattgtaagaaataaagttttttccttgaagttttgctttttgtgctggtgtaaattttcgatcttggatttattgaagactttaatttaatctcttttttttttttttttttttctcaaaggccaaagcaatcaatttgatgaaacatctagggatatatataaccaaatgtaaactgaacttttgaaccaaaatcaatattttattcattc

SEQ ID NO: 141 - protein, 317 aa, Arabidopsis thaliana
MKSGGNTNTKLILVHPYIQKQTSTNRLWLLAFVSFFTIAFLLTLLYTTDSIISSKNNSATVSSAVNSAVTTATISQLPTTAINAMLHYASRSNDSYHMSYGEMKSISDVLRRCSPPCNLLVFGLTHETLLWKSLNHNGRTVFIEENRYYAAYFEEIHPEIEVFDVQYTTKAREARELVSAVKEAARNECRPVQNLLFSDCKLGLNDLPNHVYDVDWDVILVDGPRGDGGDVPGRMSSIFTAAVLARSKKGGNPKTHVFVHDYYRDVERLCGDEFLCRENLVESNDLLAHYVLEKMDKNSTQFCRGRKKKRSVSSPSA

SEQ ID NO: 142 - DNA, 954 bp, Arabidopsis thaliana
atgaaaagtggagggaacacaaacactaaactcatacttgttcatccatacattcaaaagcaaacaagcacaaatcgtctatggcttctcgctttcgtttctttcttcacaatcgcttttctcctaactcttctctacaccaccgactccatcatctcttctaaaaacaactccgccaccgtctcctccgccgtcaattctgccgtcaccaccgctaccatctctcagttaccaacaacagccatcaatgcaatgcttcactacgcttcaagatcaaacgacagctaccacatgtcatacggagagatgaaatcaatctccgacgtcctccgccgctgctctccgccgtgtaatctcttagtcttcggtcttacacacgaaacccttctctggaaatcgctaaaccacaacgggcgtacagttttcatcgaagagaatcgttactacgctgcttacttcgaagaaatccacccggagatcgaagtcttcgatgttcagtacacgaccaaagctcgtgaggcgcgtgagcttgtgtcggcggttaaagaagcggcgaggaacgagtgtcgtccagtgcagaatcttctcttttcagattgtaaattaggactcaatgatttgccgaatcatgtatacgatgttgattgggatgtgatcttagttgatggaccacgtggcgacggtggagatgtaccggggaggatgtcgtcgattttcacggcggcggttcttgctcggagtaaaaaaggcgggaatccgaagacgcatgtgtttgttcatgattattacagagatgttgagagactttgtggggatgagtttctttgccgggagaatcttgtggaatctaatgatctgcttgcgcactacgtgttggagaagatggataaaaacagcacgcagttctgtcgtggtcgtaagaagaaacgctctgtttcttctccatcggcttga

SEQ ID NO: 143 - protein, 310 aa, Medicago truncatula
MKNNSNPKLILLHHSLHKQAPTTPFHSHRLWLFFFLLTFFTIVFTLTLITTITSSTSSATSSTASPLPPSVTKALLHYASSLNTTTKSMSFEEINAITTTLHLTPHPNFLIFGLTHESLLWSALNQNGRTVFIDENEYMISKFEQSNPGIEAYDVQFTTKVSEYPKLLSHAKAKSKHDCKPVQNLLFSECKLGINDLPNHIYQVSWDVILVDGPRGYFPAAPGRMSAIFTAAVLARSKKMGKTHIFVHDFGREVEKIFSYEFLCEENLVNNVDQLGHFVVKSETDSGESSEFCRSSNSPLLSVSVSKDVD

SEQ ID NO: 144 - DNA, 933 bp, Medicago truncatula
atgaagaacaattcaaatcctaagcttatacttctccatcattctcttcacaaacaagctccaacaacaccctttcactctcaccgtctttggcttttcttcttccttctaacattcttcactatagtcttcactctcactctcatcaccaccatcacctcttccacctcctcggccacatcctccaccgcctctcctcttccaccctccgtaaccaaagccctcctccactatgcctcctccttaaacaccaccaccaaatccatgtcctttgaagaaatcaacgctataacaaccactcttcaccttacaccacaccccaacttcctcatctttggtctcacccatgagtcacttctctggtctgcactaaaccaaaatggccgcactgttttcatcgacgaaaacgaatacatgatctcaaaatttgaacagtccaacccaggaatagaagcttatgatgttcagttcacaaccaaagttagtgagtatcctaagcttctttctcatgcaaaagcaaagtctaaacacgattgtaaacctgtgcagaatttgttattctcagagtgtaaactcggaatcaacgatttgccgaatcacatttaccaagtctcttgggatgtgattcttgttgatgggccaagagggtactttccggcagctccggggagaatgtcggcgatctttacagcagcagtgttggctaggagcaagaaaatgggaaaaactcacatatttgttcatgattttggaagagaagtggagaagattttcagctatgagtttctttgtgaagagaatttggttaacaatgtagatcagttagggcattttgtggtgaagagtgaaaccgacagtggtgaaagttctgagttttgcagaagttctaactctccgttgttgtctgtgtcggtgtcaaaggatgttgactga

SEQ ID NO: 145 - protein, 392 aa, Oryza sativa
MQLSFTPSTHSRTQAQTVCVSVRQGGRRRGAKNCGGGGGGERRKEMKGMSGPKLLVVHPASKGYNGVVSLSGAASPGPSAASMPLFLGSRRRCCAWLVALLLALLTCVSLLTVFSTARAASEGAALPQRARLTVAGAAGAAAASAAVGAAGGLPAYVFDALVQYAAAAGANATASMPEEDVRAIASVLRRRAPCRLLVFGLGAETPLWRALNHGGRTVFLDENPFYVAHVEGALPGLEAYDVSYATAVREFPDLLDAARAAQSADCRPVQNLLFSDCRLAINDLPNQLYDVSWDVILVDGPSGFTEGSPGRMSAIFSAAVMARTKGSETEVLVHDYQREVEIACAREFLCPENRVEATATPSLGHFLVRGGAAANRDAFCGGAAGATTKKAN

SEQ ID NO: 146 - DNA, 1410 bp, Oryza sativa
tgaaccattcttccttcctcatcacctcatctactaaacacaaaagaacacaagctccagataattatatgcaactatccttcactccaagtactcactcaagaacacaagctcagacagtttgtgtgtcagtgaggcaaggaggaagaagaagaggagccaagaattgcggcggtggcggcggcggcgagaggaggaaggagatgaaggggatgtccgggccgaagctgctcgtcgtgcacccggcgtcgaaggggtacaacggcgtggtgtcgctgtccggcgcggcgtcgccggggccgtcggcggcgtccatgccgttgttcctcggctcgcggcggcgttgctgcgcctggctcgtcgcgctcctcctcgcgctgctcacctgcgtgtccctgctcaccgtcttctccacggcgcgcgccgcgtcggaaggcgcagcgctgccgcagcgcgcgaggctcaccgtcgcgggcgcggcgggcgccgccgcggcgtcggcggcggtgggagcagcgggcgggctgccggcgtacgtgttcgacgcgctggtgcagtacgcggcggcggcgggggcgaacgcgacggcgagcatgccggaggaggacgtgcgggcgatcgcgtcggtgctccggcggcgcgcgccgtgcaggctgctggtgttcggcctcggcgccgagacgccgctgtggcgcgcgctgaaccacggcgggcggacggtgttcctggacgagaacccgttctacgtggcgcacgtggagggcgcgctcccgggcctggaggcgtacgacgtctcgtacgccaccgccgtccgcgagttccccgacctcctcgacgccgcccgcgccgcccagtccgccgactgccgccccgtccagaacctcctcttctccgactgccgcctcgccatcaacgacctccccaaccagctctacgacgtctcctgggacgtcatcctcgtcgatggcccaagcgggttcacggaggggtcgccggggaggatgtcggcgatcttctcggcggcggtgatggcgaggaccaaggggtcggagacggaggtgctggtgcacgactaccagcgggaggtggagatcgcgtgcgcgagggagttcctgtgcccggagaaccgcgtggaggccaccgccacgccgtcgctcggccacttcctcgtccgcggcggcgccgccgccaaccgggacgccttctgcggcggcgccgccggcgccaccaccaagaaggccaactaagcttagtgatcaattcactactagccatagccacgaatccgccgtctttttttccccgatctcttctcgacttcttgctgtgtatttgatcgtcgcctccatgaattatatcttattcatgcacgcgaaattgagcacgaaatcggtctcgagagatgaatgt

SEQ ID NO: 147 - protein, 311 aa, Populus trichocarpa
MKNNNNNNTKLILLHPYIQKQGGSNRLWLLAFVSFFTIAFLLTLIYTRETLPIKTITTTMATGSASSSTFGNNAPLPTTVINTLLHYASRSNDSFHMSHAEIKPISDVLRKCSSPCNFLVFGLTHETPLWKALNHNGRTVFIEENRYYAAYYEELHPEIDVFDVQYTTKMKEMRELIASTKEQIKNECRPVQNLLFSECKLGINDLPNHVYEVDWDVILIDGPRGDGPEGPGRMTPIFTSGVLARSKKASNAKTHIFVHDYYRNVERIYGDEFLCRENLVESNDMLAHFVVEKMDENSFQFCRNHTAASSP

SEQ ID NO: 148 - DNA, 1339 bp, Populus trichocarpa
tcttttctcatttccatcaagattcaagatcttgaccaccacagcacagccagatcagagatttcacgcttacacttctctctctctttctctccctctcactcaaaaaatgaagaacaataacaataacaacacaaagctgatccttcttcatccttacatccagaaacaaggaggctccaatcgattatggctccttgcctttgtatctttcttcaccatcgctttccttcttacactaatctacacgagagagactttacctataaaaaccatcaccaccaccatggccactggctccgcttctagctccacctttggcaataatgctccactgccaacaacagtaatcaatactctcctccactatgcctcgagatccaatgacagtttccatatgtcccatgccgaaatcaagccaatatctgatgtacttagaaagtgttcatctccttgtaactttcttgtttttggtctaacacacgagacacctctttggaaagctcttaaccacaacggccgcaccgttttcatcgaagaaaaccgctactacgcagcttattatgaagagttgcatcctgaaattgatgtctttgatgtccaatacacaaccaagatgaaagaaatgagagagcttattgcctccaccaaggagcaaataaaaaatgaatgcaggccagtgcagaatttactcttctcagagtgtaagcttgggattaatgacttgcctaatcatgtttacgaggttgactgggatgtgatattgatcgatgggcctagaggggatggaccagaggggccggggaggatgacaccaatcttcacatctggtgtgctagctaggagcaagaaggctagcaatgctaagactcacatattcgtgcatgattactacagaaatgtggagagaatttatggtgatgagttcttgtgcagagagaacctggtggagtctaatgacatgcttgctcattttgtggtagagaaaatggatgagaatagcttccagttctgtcgcaaccatacagcagcttcttctccctaattgtttcgagtatcctcttgatcatgataagggtcttcccaaggggtcaatggtggtataaacaaggtataaaatgtggtttatttatgatcatttcaaattcttagaccctccttttgttcttcccttttctcttttctttggctggggagtgtaaaaaataattctttttggctatgtaagttgtaatttcacggaattgaaagtctcagttgtcaattttgtgttatttctctttgttcattgctatggcagcacaatgctcaagtcagaaacaaataaatagttcagatg

SEQ ID NO: 149 - protein, 321 aa, Sorghum bicolor
MMKAMAGPKLLVVHTSSNKALNGMAPASPMPFHGWSRCMWLVVFLALFTCVSLLTVFSTARASAGAAYQAAPFTASAGAAEAGLPRYVFDALVHYAAAAGNSSSSMPEPDVRAIASVLRRRAPCNLLVFGLGAETPLWRALNHGGRTVFLDENPYYVAHLEGKHPGLEAYDVAYATAVRELPDLLDAARAARAAECRPVQNLLFSECRLAINDLPNQLYDVAWDVILVDGPRGFTEGSPGRMSAIYSAAVMARTKGTETEVMVHDYEREVERACGREFLCDENGVAATSTPSLGHFLVRGGAAVNREAFCGPPAAQKSKSN

SEQ ID NO: 150 - DNA, 1406 bp, Sorghum bicolor
cccatcccatcccatcccagtcccatcccaacctccattccttcgtcccttgccaactctgatctctcacctgaaaaatgtcagcgtgagtagccattccatctgcacagcacctcgtctactaaacctcattagcattcactccagagtccagacgcacacaaaggccagagtcggaggagatgatgaaggccatggccggtccgaagctgctcgtcgtccacacgtcgtcgaacaaggccctgaacgggatggcgccggcgtcgcccatgccgttccatgggtggtcccggtgcatgtggctggtggtcttcttggccttgttcacctgcgtgtccctcctcaccgtgttctccacggcgcgcgcctcggccggggcggcgtaccaggcggcgcccttcacggccagcgccggcgccgcggaggctggcctgccgcggtacgtgttcgacgcgctggtgcattacgcggcggcggcggggaactcgtcgtcgagcatgccggagccggacgtgcgcgcgatcgcgtcggtgctccggcggcgcgcgccgtgcaacctgctggtgttcgggctgggcgcggagacgccgctgtggcgcgcgctgaaccacggcgggcgcacggtgttcctggacgagaacccctactacgtggcgcacctggaagggaagcacccggggctggaggcctacgacgtggcctacgccacggcggtgcgcgagctcccggacctcctcgacgccgcccgcgccgcgcgcgccgccgagtgccgccccgtccagaacctgctcttctccgagtgccgcctcgccatcaacgacctccccaaccagctctacgacgtcgcctgggacgtcatcctcgtcgacggcccgcgcgggttcacggaggggtcgccggggaggatgtcggcgatctactcggcggcggtgatggcgcggaccaagggcacggagacggaggtgatggtgcacgactacgagcgggaggtggagcgcgcgtgcggccgggagttcctgtgcgacgagaacggggtcgcggcgaccagcacgccgtcgctcggtcacttcctcgtgcgcggcggcgccgccgtcaaccgggaagccttctgcgggccgcccgccgctcagaaatcgaaatcgaactaagcgacgagtagttacttctgcttcccccgtttttagccccaacatgctccagttctttgagcgatgatcttcctcgtcctgtcgtccaggcagataaattgacaggagaaagtaatgaactcgcagaattgtgtcaatgtagcatagagatcagtggttccttgtattcttatcgcacaaatcttctttgtgagttgtggtgggtccaatgatttctcccttcaaacatatggtaatgcctgacgtgccaacgcattg

SEQ ID NO: 151 - protein, 513 aa, Arabidopsis thaliana
MATLFLTILLATVLFLILRIFSHRRNRSHNNRLPPGPNPWPIIGNLPHMGTKPHRTLSAMVTTYGPILHLRLGFVDVVVAASKSVAEQFLKIHDANFASRPPNSGAKHMAYNYQDLVFAPYGHRWRLLRKISSVHLFSAKALEDFKHVRQEEVGTLTRELVRVGTKPVNLGQLVNMCVVNALGREMIGRRLFGADADHKADEFRSMVTEMMALAGVFNIGDFVPSLDWLDLQGVAGKMKRLHKRFDAFLSSILKEHEMNGQDQKHTDMLSTLISLKGTDLDGDGGSLTDTEIKALLLNMFTAGTDTSASTVDWAIAELIRHPDIMVKAQEELDIVVGRDRPVNESDIAQLPYLQAVIKENFRLHPPTPLSLPHIASESCEINGYHIPKGSTLLTNIWAIARDPDQWSDPLAFKPERFLPGGEKSGVDVKGSDFELIPFGAGRRICAGLSLGLRTIQFLTATLVQGFDWELAGGVTPEKLNMEESYGLTLQRAVPLVVHPKPRLAPNVYGLGSG

SEQ ID NO: 152 - DNA, 1835 bp, Arabidopsis thaliana
gttttgtttcctcatttttcacttaccattcaaacccaacactatggcaactctatttctcacaatcctcctagccactgtcctcttcctcatcctccgtatcttctctcaccgtcgcaaccgcagccacaacaaccgtcttccaccggggccaaacccatggcccatcatcggaaacctccctcacatgggcactaagcctcatcgaaccctttccgccatggttactacttacggccctatcctccacctccgactagggttcgtagacgtcgtggtcgccgcttctaaatccgtggccgagcagttcttgaaaatacacgacgccaatttcgctagccgaccaccaaactcaggagctaaacacatggcatataactatcaagatcttgtctttgcaccttacggacaccgatggagactgttgagaaagattagttctgttcatctattttcagctaaagctctcgaagatttcaaacatgttcgacaggaagaggttggaacgctaacgcgggagctagtgcgtgttggcacgaaacccgtgaatttaggccagttggtgaacatgtgtgtagtcaacgctctaggacgagagatgatcggacggcgattgttcggcgccgacgccgatcataaagctgacgagtttcgatcaatggtgacggaaatgatggctctcgccggagtattcaacatcggagacttcgtgccgtcacttgattggttagatttacaaggcgtcgctggtaaaatgaaacggcttcacaagagattcgacgcttttctatcgtcgattttgaaagagcacgaaatgaacggtcaagatcaaaagcatacagatatgcttagcactttaatctcccttaaaggaactgatcttgacggtgacggaggaagcttaacggatactgagattaaagccttgctattgaacatgttcacagctggaactgacacgtcagcaagtacggtggactgggctatagctgaacttatccgtcacccggatataatggttaaagcccaagaagaacttgatattgttgtgggccgtgacaggcctgttaatgaatcagacatcgctcagcttccttaccttcaggcggttatcaaagagaatttcaggcttcatccaccaacaccactctcgttaccacacatcgcgtcagagagctgtgagatcaacggctaccatatcccgaaaggatcgactctattgacgaacatatgggccatagcccgtgacccggatcaatggtccgacccgttagcatttaaacccgagagattcttacccggtggtgaaaaatccggcgttgatgtgaaaggaagcgatttcgagctaataccgttcggagctgggaggagaatctgtgccggtttaagtttagggttacgtacgattcagtttcttacggcgacgttggttcaaggatttgattgggaattagctggaggagttacgccggagaagctgaatatggaggagagttatgggcttacactgcaaagagcggttcctttggtggtacatcctaagccaaggttggctccgaacgtttatggactcgggtcgggttaaaatttaactttgcttcttggacaaggtatatggcttgcacgaaaataaagttttaaaacagcgtagtttgatccggagttagctttatgtaagaacgtgtaacgccaaatcaagtcattattaaatattgtgagttgtttgtaacctatatataaatcttgaagaggaagatttcagaaatcttgaatatgttttaggaaaaacattgttttttttacagtagcgcaagttgaattaaaacctattcctt

SEQ ID NO: 153 - protein, 535 aa, Oryza sativa
MEVAAMEISTSLLLTTVALSVIVCYALVFSRAGKARAPLPLPPGPRGWPVLGNLPQLGGKTHQTLHEMTKVYGPLIRLRFGSSDVVVAGSAPVAAQFLRTHDANFSSRPRNSGGEHMAYNGRDVVFGPYGPRWRAMRKICAVNLFSARALDDLRAFREREAVLMVRSLAEASAAPGSSSPAAVVLGKEVNVCTTNALSRAAVGRRVFAAGAGEGAREFKEIVLEVMEVGGVLNVGDFVPALRWLDPQGVVARMKKLHRRFDDMMNAIIAERRAGSLLKPTDSREEGKDLLGLLLAMVQEQEWLAAGEDDRITDTEIKALILNLFVAGTDTTSTIVEWTMAELIRHPDILKHAQEELDVVVGRDRLLSESDLSHLTFFHAIIKETFRLHPSTPLSLPRMASEECEIAGYRIPKGAELLVNVWGIARDPAIWPDPLEYKPSRFLPGGTHTDVDVKGNDFGLIPFGAGRRICAGLSWGLRMVTMTAATLVHAFDWQLPADQTPDKLNMDEAFTLLLQRAEPLVVHPVPRLLPSAYNIA

SEQ ID NO: 154 - DNA, 2124 bp, Oryza sativa
ggtggtaggtaagggatctcaggatgggacctggcacccatatccaccaaccactgttgtccctgagataatagacgcgtgctttgcagagtgatccaaagctagctagtcctaccaacaatggaggtcgccgccatggagatctctacctcattgctcctcaccaccgtggctctctccgtcatcgtgtgctacgccctggtcttctcccgcgccgggaaggcgcgtgcgccgctgccgctgccgcctggccccaggggatggccggtgctgggcaacctgccgcagctgggcgggaagacgcaccagacgctgcacgagatgaccaaggtgtacggcccgctgatccggctccggttcgggagctccgacgtggtggtcgccggctcggcgccggtggcggcgcagttcctccgcacccacgatgccaacttcagcagccggccacgcaactccggcggcgagcacatggcgtacaacggccgggacgtcgtgttcgggccgtacgggccgcggtggcgcgccatgcggaagatttgcgccgtcaacctcttctccgcgcgcgcgctcgacgacctgcgcgctttccgggagcgggaggccgtgctgatggttaggtcgctggcggaggcgagcgccgcccctgggtcgtcgtctccagcggcggtggtcctgggaaaggaggtgaatgtctgcacgacgaacgcgctgtcgcgcgccgcggtcgggcgccgcgtgttcgccgccggcgcgggcgagggcgcgagggagttcaaagagatcgtgctggaggtgatggaggtgggtggtgtgctgaacgtcggcgacttcgtgccggcgctccggtggctggacccgcagggcgtggtagcgaggatgaaaaagctgcaccgccggttcgacgacatgatgaacgcgatcatcgcggagaggagggccggatcactactcaaaccaaccgacagtcgtgaggaaggtaaggacttgcttggcttgctcctggctatggtgcaggagcaggagtggctcgccgccggcgaggacgacaggatcaccgacacggaaatcaaggcccttatcctgaatctattcgtggcgggcacagacacaacatcaaccatagttgagtggacaatggcagagctgattcgacacccagatatcctcaagcacgcccaagaggagctagatgttgttgtgggtcgtgataggctcctctcagagtcggatctatcacatctcaccttcttccatgctatcatcaaggagacattccgtctacatccatcaacaccgctctcgctgccacgcatggcatctgaggagtgtgagatcgcaggctaccgtatccccaagggtgcagagttgctggtcaatgtgtgggggatcgcccgtgacccagccatatggcctgacccactagagtacaagccctctcggttcctccccggtgggacgcacactgatgtggatgtcaagggaaatgatttcggacttataccattcggtgcagggcgaaggatatgcgccggcctcagttggggcctgcggatggtcaccatgacagcggccacgctggtgcatgcattcgactggcagctaccagcggaccagacgccagacaagctcaatatggatgaggcgtttaccctcctgctgcaaagggcagagccattggtggttcacccggtaccaaggcttctcccatccgcttacaatattgcataaagatttacgagttgaatataattaacgaaaagttatttccgtgtgtgtggcatcaaataaatagagggtatgaacttttgtcatggtgttgcatcattgttgtatgttggtagattggtttttcacgagtatctatactccttataaaaaggagtagtggtgatgattctgctaccaccccactaccaactcttatctttttttaaggacatctaggattagtgggcccatatgtcattactctcaccaacttttattcttgtgaaaggttattaccgtgcgaataaatagtgggtttgaactgtcgttgtgttatatcattcgatgtatgttgattggttttgtttttcacaaggagtatacatatattaagggacagaataattgtcagtcgct

SEQ ID NO: 155 - protein, 521 aa, Populus trichocarpa
MSPLILYSALLAIFVYCLLQLRSLRDRHGKPLPPGPKPWPLVGNLPHLGPMPHHSMAALAKTYGPLMHLRFGFVDVVVAASASVAAQFLKVHDSNFSSRPPNSGAKHIAYNYQDLVFAPYGPRWRMLRKISSVHLFSAKSLDDFRHIRQEEVAVLTGALTRSGPTTPVNLGQLLNVCTANALGRVMLGRRVFGDGSGDGDPKADEFKSMVVEVMVLAGVFNIGDFVPALEWLDLQGVAAKMKKLHKRFDAFLTNIVEEHKTSSSTASVRSEKHTDLLSTLIALKEQQDVDGEEGKLTDTEIKALLLNMFTAGTDTSSSTVEWAIAELIRHPDILAQVKQELDSVVGRDRLVTELDLAQLTYLQAVVKETFRLHPSTPLSLPRIAAESCEIGGYHIPKGSTVLVNVWAIARDPDVWTKPLEFRPERFLPGGDKADVDVKGNDFELIPFGAGRRICAGMSLGLRMVQLLTATLIHAFDWDLADGLVPEKLNMDEAYGLTLQRADPLMVHPRPRLSPKVYRTPN

SEQ ID NO: 156 - DNA, 1787 bp, Populus trichocarpa
ttcaagttaatacaggaaacaagagataatcatgtctcctctaatactttactcggcactattggccatcttcgtctattgccttcttcagctgcgaagccttcgtgaccgtcacggcaaaccccttccaccaggcccaaaaccatggcccctagttggaaacctaccccatttggggcctatgcctcaccactccatggcagccctggcaaagacttatggacctctcatgcacctccggttcggcttcgtcgacgtggtggtggcggcatcggcttccgtggctgctcagtttttgaaagtacatgattccaacttctctagcaggccaccaaactccggtgccaaacatattgcatataattaccaagaccttgtgtttgcaccctatgggccacggtggcgcatgcttcggaagatcagctccgtccatctcttctcggctaagtccttggatgattttagacatattagacaggaagaagtggcagtgcttacaggggcactgacaagatcaggtccaactacaccagtgaacttgggtcaattgctcaatgtttgcacagctaacgctcttgggagggtgatgctagggaggcgcgtgttcggcgacggcagtggtgatggtgacccgaaggcagatgaattcaagtcaatggtggtggaggtaatggtgttggctggtgtgtttaacatcggtgactttgttcctgctttggagtggcttgacttgcagggtgtagcagctaaaatgaagaagcttcataagagatttgatgctttcttgactaacattgtagaggagcataaaaccagcagcagcactgcttctgttagatcagagaagcacactgatctgttgagtacgttgattgctctgaaggagcagcaggatgttgatggtgaggaagggaagctgactgacactgaaatcaaagcattgctcttgaatatgttcactgctggcaccgacacatcgtcgagcacagtggaatgggctattgcagagcttatacggcacccagacatcctggcccaggtcaaacaagagctcgactccgtcgtcggtcgagaccgtctggtaactgaattggacttggcgcaactcacctacctccaagccgtggtcaaggaaaccttccggctccacccttcaacaccgttgtctcttccacgcattgccgcggaaagctgcgagattggtggctaccacattccgaagggctcgactgttttggtgaatgtatgggccatagctcgtgaccccgatgtatggactaagccgcttgagtttcgtcccgaaaggtttcttcccggtggggacaaggctgatgttgacgttaagggaaatgattttgagcttataccattcggtgctgggcgtaggatttgtgcagggatgagtctcgggctgcgtatggttcagctattgactgcaactttgatccacgcctttgactgggatttggccgatgggttggtaccggagaaattgaacatggacgaggcctatggtctgactttacaacgtgccgaccccttaatggtgcaccctaggccaaggttatccccaaaagtctaccggacaccaaattaaaaaaaaaaggataatcatgatgctagcgtttttttttttttttttttgagagtgtgagataatctctctatttatatgtgtttgatatgtaaaacaaaaaaatcagactttgcaatgccgtgtgagttgtctgaagattttcaatgttgtatgactaaatgcaaaataaattgccttttttttttttttt

SEQ ID NO: 157 - protein, 577 aa, Arabidopsis thaliana
MALQLLLAVFSCVLLLPQPAFGITRHYTLEIKMQNVTRLCHTKSLVSVNGQFPGPKLIAREGDQVLIKVVNQVPNNISLHWHGIRQLRSGWADGPAYITQCPIQTGQSYVYNYTIVGQRGTLWYHAHISWLRSTVYGPLIILPKRGVPYPFAKPHKEVPMIFGEWFNADTEAIIRQATQTGGGPNVSDAYTINGLPGPLYNCSAKDTFRLRVKPGKTYLLRLINAALNDELFFSIANHTVTVVEADAIYVKPFETETILIAPGQTTNVLLKTKSSYPSASFFMTARPYVTGQGTFDNSTVAGILEYEPPKQTKGAHSRTSIKNLQLFKPILPALNDTNFATKFSNKLRSLNSKNFPANVPLNVDRKFFFTVGLGTNPCNHKNNQTCQGPTNTTMFAASISNISFTMPTKALLQSHYSGQSHGVYSPKFPWSPIVPFNYTGTPPNNTMVSNGTNLMVLPYNTSVELVMQDTSILGAESHPLHLHGFNFFVVGQGFGNFDPNKDPRNFNLVDPIERNTVGVPSGGWAAIRFLADNPGVWFMHCHLEVHTSWGLRMAWLVLDGDKPDQKLLPPPADLPKC

SEQ ID NO: 158 - DNA, 2049 bp, Arabidopsis thaliana
gcaaaacataagcgaggcagagtcttcagaaaacttacctgctctaaacaacgcctccgtgtccaagctcacttcaatggcgttacagctactcctagctgtattctcttgtgttcttcttcttcctcaacctgcatttgggattacaaggcattatacgctggaaatcaaaatgcagaacgtaacacgtctttgccacacaaagagccttgtttctgtaaacgggcagtttccaggtcctaagcttattgctagagaaggtgaccaggttctgatcaaagtcgttaatcaagtgccaaacaacatctctctccactggcatgggatccggcaattacgaagtggttgggctgatggtccagcctatataacccaatgtcctattcagacaggacaaagctatgtttacaactataccattgttggtcaacgaggcactctgtggtaccatgctcacatttcatggctaagatcaacagtctatggtccacttatcatccttcccaaacgcggagttccttacccgtttgctaaacctcacaaagaagttcccatgatctttggggagtggttcaacgcagacactgaggcaatcatccgccaagcaacccaaacaggaggtggtcccaatgtctctgatgcttacacgataaacgggcttcctggtccattatacaactgctccgcaaaagatacattcagactgagagtgaagccaggaaaaacataccttctcaggctaatcaatgctgcacttaatgacgagctctttttcagcatcgcaaatcacacggttacggttgttgaagctgatgcgatctatgttaagccatttgagactgaaaccatcttaattgctcctggtcagaccacaaacgtcctgctgaagactaaatctagttatccgagtgcctccttcttcatgactgctagaccatacgtcacaggtcaaggaacttttgataactctacagttgctggaatcttagaatatgaaccacctaaacagaccaaaggtgctcactcaaggacctctatcaaaaatcttcaactcttcaaaccgatactccctgctctaaacgatacaaattttgctaccaagttcagtaataagctacgcagcctgaacagcaaaaactttccagcaaacgtgcctctgaatgttgatcggaagttcttcttcacagtaggactgggaacaaacccgtgcaatcataagaataaccagacatgccaaggtcctactaacaccacaatgtttgctgcttcaatcagtaacatttcattcacaatgccaacaaaagctctccttcaatctcactattctgggcaatctcatggagtgtattccccaaaattcccatggagtcccattgtcccttttaactacacaggcactccacctaacaatactatggttagtaacgggacaaacttgatggttctaccttataacaccagtgtggagttggtgatgcaagacactagcattcttggcgcagaaagccatcctcttcatcttcatgggttcaacttctttgttgttggccaagggtttgggaatttcgacccgaacaaggatcctagaaacttcaaccttgttgacccaatagagaggaacacagtcggtgtgccatctggtggatgggctgctattcgattccttgcagataacccaggagtgtggttcatgcactgtcacttggaagtgcataccagttggggtctgaggatggcttggcttgttcttgatggagataaacctgatcagaaacttcttcctcctcctgcagacttgcccaaatgctgagaattctttccccatgattcaagtcctttttctttttgtttcttgtctcttctttcttacaagcttcgcacatttttttcgtttttttcctcggccatttatcggtttgacatgaggtcaattcctgttcaataatttgacatgaggtcaatttctttacaattatttactgttgcacagctctgttttctgcaagtgtagatctatgtaaacccaaaactaatatatatacacaatct

SEQ ID NO: 159 - protein, 585 aa, Medicago truncatula
MHIKMIVTVPLSKALFAAFLFVTTFLLTSPGFVLATSQHGSVTRHYKFDIRLANVTRLCHTKSMVTVNGKFPGPRIVVREGDRLLVKVVNHVPNNISLHWHGVRQLRSGWSDGPSYITQCPIQTGQSYVYNFTIVGQRGTLFWHAHFSWLRATVYGPLILLPRHNESYPFQKPYKEVPILFGEWWNADPEAVIAQALQTGGGPNVSDAYTINGFPGPLYNCSKDTYKLKVKPGKTYLLRLINAALNDELFFSIANHTLIIVEADASYIKPFESNTIILGPGQTTNVLLKTKPNYPNSTFYMLARPYFTGQGTFDNSTVAGILEYTKPNDQTNLNLPILKPVLPVINDTNFVANFSNKFLSLNSPKYPANVPKTIDKNFFFIVGLGTSPCPKNQTCQGPNNSSKFAASMNNVSFALPSIALLQQHFFGANNGFTTDFPVVPLRPFNYTGTPPNNTLVSNGTKTVVIPYNTRVQVILQDTSILGAESHPLHLHGFNFFVVGQGFGNFNASSDPAKFNLVDPVERNTVAVPSGGWVAIRFLADNPGVWLMHCHFDVHLSWGLRMAWIVEDGKLPDQKLPPPPKDLPKC

SEQ ID NO: 160 - DNA, 1758 bp, Medicago truncatula
atgcatatcaaaatgattgtcactgttccattatcaaaggctctttttgcagcctttctctttgtcaccaccttcctcttaacctcccctggatttgttttggctacttcacagcatggaagtgttacaagacactacaaattcgatataaggttggcaaacgttacgaggctgtgccacacaaaaagcatggtcaccgtgaatgggaagttcccgggtcctcgaattgttgttagagaaggggacagattgttggttaaggttgttaatcatgttccaaacaatatcagcttgcattggcatggtgtgagacaacttcgtagtggttggtcggatggtccatcatacataactcaatgcccaattcaaacaggtcagagttatgtgtacaacttcaccattgttggacaaagaggaactcttttctggcatgctcatttctcatggttaagagctactgtctatggacctctcatccttctcccaaggcacaatgaatcttatccttttcaaaaaccctacaaggaagtccccattctctttggtgagtggtggaatgcagatcctgaagctgtaattgcacaagctcttcagacagggggtggcccaaatgtttctgatgcctacaccattaatgggtttcctggacctctttacaattgctccaaagatacatacaaattgaaggtgaagccaggaaaaacatatttactacgtttaatcaacgctgcactcaatgacgaactctttttcagcattgctaatcacacattaatcattgttgaagcagatgcatcttacattaaaccattcgagtccaataccatcatacttggaccaggtcaaaccacaaatgttctattaaaaacaaaaccaaattaccctaattccacattctacatgctagctagaccatatttcacagggcagggtactttcgacaattccacagtagctggaattttagaatacactaaaccaaatgatcaaacaaatttaaatctccctattctaaaacctgtgcttccagtcatcaatgatactaattttgttgctaattttagtaacaaatttcttagcttaaatagtccaaaataccccgcaaatgtgccaaaaactattgacaaaaactttttctttatcgttggactaggaactagtccatgcccaaaaaaccaaacatgtcaaggaccaaataatagttcaaaatttgcagcttcaatgaacaatgtatcatttgctttaccttctatagcacttcttcaacaacatttctttggagctaataatggttttacaacggattttccggttgtaccgttaaggccgtttaattatacaggaacacctccaaacaatactttggttagtaatggaacaaagacagtggtgataccatataacactagagttcaggttatattgcaggatacaagcattttgggagctgagagtcatcctttgcatcttcatggatttaatttctttgttgttggtcaaggttttggaaattttaatgctagtagtgaccctgcaaagtttaatcttgttgatcctgttgagaggaatactgttgctgtgccttctggtggttgggttgcgatacgattccttgctgacaatccaggtgtttggctgatgcattgccactttgatgtgcaccttagttggggattgaggatggcttggattgttgaagatggaaagttaccagatcaaaaattgcctcctcctcctaaggatctccccaaatgttga

SEQ ID NO: 161 - protein, 578 aa, Oryza sativa
MGARCLALLLLYGTLLLLLLLPQLPLAGAATRYYTFNVKLQNVTRLCNTRAIPTVNGKFPGPKIVTREGDRVVVKVVNNIKDNITIHWHGVRQMRTGWSDGPAYVTQCPIQTGQSYVYNFTINGQRGTLFWHAHVSWLRSTLYGPIIILPKAGLPLPFTEPHKDVPIIFGEWFNADPEAIVAQALQTGGGPNVSDAYTINGLPGPLYNCSSKDTFRLKVQPGKMYLLRLINAALNDELFFSVANHTLTVVDVDASYVKPFDTDVVLITPGQTTNVLLRAKPTAEAAGATHLMMARPYATGRPGTYDNTTVAAVLEYAPPGHIKSLPLLRPSLPALNDTAFAAGFAAKLRSLACPDYPSNVPRRVDKPFFFAVGLGTTPCPGSNNQTCQGPTNTTKFTASINNVSFDMPTTALLQAHYTGQSAGVYTADFPASPLEPFNYTGTPPNNTNVSNGTRVVVLPYNASVEVVLQDTSILGAESHPLHLHGFDFFVVGQGTGNYDPSKHPAEFNLVDPVQRNTVGVPAGGWVAIRFFADNPGVWFMHCHLEVHTTWGLKMAWVVNDGPLPEQKLMPPPSDLPMC

SEQ ID NO: 162 - DNA, 2272 bp, Oryza sativa
acttgcctgttctagtatctatagctagctaactgttactgtacctcctcccatatatcatcttcatatttttgcagatcgataagcgagaaaaatgggagcacgctgcctcgcattgcttctcctctatggcacgttgctgctgctgttgctgctgccacagctgccgctcgccggcgcggcgacgagatactacaccttcaatgtgaagcttcagaatgtgacacggctgtgcaacacccgggcaatcccgacggtgaacggcaagttccccgggccgaaaatagtcaccagggagggagaccgcgtcgtcgtcaaggtggtcaacaatatcaaggacaacattaccatccactggcacggggtgaggcagatgcggacggggtggtcggacgggccggcgtacgtgacgcagtgcccgatccagacggggcagagctacgtgtacaacttcaccatcaacgggcagaggggcaccctgttctggcacgcgcacgtctcctggctgcgatccacgctgtacggccccatcatcatcctccccaaggccggcctcccgttgcccttcaccgagccgcacaaggacgtgcccatcatcttcggagagtggtttaacgcggaccctgaggcgatcgtcgcgcaggcgcttcagaccggcggtgggcccaacgtctccgacgcctacaccatcaacgggcttcccggcccattgtacaactgctcaagcaaagacacgtttaggctcaaggtgcagcccggaaagatgtacctgctccggctgatcaacgctgcgctcaacgacgagctcttcttctcggtggccaaccacacgctcaccgtcgtcgacgtggacgcctcctacgtcaagccgttcgacacggacgtggtcctcatcacgccggggcagaccaccaacgtgctgctccgcgccaagccgacggccgaggccgccggcgccacgcacctcatgatggcgcgcccctacgccacgggccgccccggcacctacgacaacaccaccgttgccgccgtcctggagtacgcgccaccggggcacatcaagagcctcccgctcctccgcccgtcgctgccggcgctcaacgacacggccttcgccgccggcttcgccgccaagctccgcagcctggcctgcccggactacccgtccaacgtgccgcgccgcgtcgacaagcccttcttcttcgccgtggggctcggcaccaccccgtgcccgggcagcaacaaccagacgtgccagggccccaccaacaccaccaagttcacggcgtccatcaacaacgtctccttcgacatgcccaccaccgcgctcctgcaggcgcactacaccggccagtccgccggcgtgtacaccgccgacttccccgcctcgccgctggagccgttcaactacacgggcacgccgcccaacaacaccaacgtgtcgaacgggaccagggtggtggtgctgccgtacaacgcgagcgtggaggtggtgctgcaggacaccagcatcctgggcgccgagagccacccgctgcacctccacggcttcgacttcttcgtcgtcgggcagggcaccggcaactacgacccgtccaagcacccggcggagttcaacctggtcgacccggtgcagaggaacaccgtcggcgtgccggccggcggctgggtcgccatcaggttcttcgcggataaccctggtgtctggttcatgcattgccacctggaggttcacacaacctgggggttgaagatggcatgggtggtcaacgacggcccgttgcctgagcagaagctgatgcctccgccgtccgatcttcccatgtgctagagatcgatcaatcgttgacattatttgaccaaggctgtgattcgtttattccgtttggtttgctacacataatttgtcaatggataatgccgtacgtacatacctgcaggattgaggtcttgttttccattcttccaaaggtgttgtttattcttgtaaggggtttgccattgttttttttttaaattctacaagtacttttagctcgaaagttcggccgtatatggtcaataagaatagtttgactcttacattttgacacccacgatgggctcaatctcagatgactatattacggactagtattttacaagcgcgaactatgtatgatactggactgttacaacaagaattcatataagatcatataagcttgtagtcggaatcaatcacgcaattaagctgatgtaagatatataaatcacggccaggtggccttgc

SEQ ID NO: 163 - protein, 570 aa, Populus trichocarpa
LAVFLFSFVTLSVNPEPALAITRHYKFDVMLQNVTRLCHTRSMVTVNGKFPGPRIVAREGDRLVIRMVNHVQNNISIHWHGIRQLRSGWADGPAYVTQCPIQTGQSYVYNYTIVGQRGTLWWHAHISWLRSTLYGPIILLPKLGTPYPFAKPYKEVPIIFGEWFNADPEAIINQAMQTGGGPNVSDAYTINGLPGPLYNCSAKDTFKLKVKPGKTYLLRMINAALNDELFFSIANHTVTVVDVDAVYVKPFDAETLLITPGQTTNVLLKTKPDYPNAQFFMSARPYATGQGTFDNSTVAGILEYEVPNKTSQSNHSTKKLPLYKPNLPPLNDTSFATNFSSKLRSLASADFPANVPQKVDRQFVFTVGLGTNPCSKNQTCQGPNGTRFAASVNNVSFVMPSTALLQAHHFGQSRGVYSPYFAISPLIPFNYTGTPPNNTMVSNGTKLVVLPFNTSVELIMQDTSILGAESHPLHLHGFNFFVVGQGFGNFDPSKDPANFNLVDPVERNTVGVPSGGWVAIRFLADNPGVWFMHCHLEVHTSWGLKMAWVVLDGKLPNQKLLPPPADLPKC

SEQ ID NO: 164 - DNA, 1710 bp, Populus trichocarpa
ctggcagtgtttctcttctcatttgtcactttgtctgtcaatcctgagcctgcacttgccattactaggcactacaaatttgatgttatgctgcaaaatgtgacacgcctttgccataccaggagcatggttacagtcaatgggaagttcccggggcctcgcattgtagctagagagggtgatcgtcttgttattagaatggtcaaccatgtccaaaacaacatctctattcactggcatgggattcgacagcttcgcagcgggtgggccgacggaccagcatacgtaactcagtgccctatacaaactggacaaagctatgtgtacaactacaccattgtaggacagagaggcactctttggtggcatgcccatatttcatggttaagatcaactctctatggtcccataatccttcttcccaaactcggaactccttacccatttgctaaaccttacaaggaggttccaatcatctttggggagtggtttaatgcagatccagaggcgatcattaaccaggcaatgcaaactggtggaggcccaaatgtctctgatgcttatactatcaatggacttccagggccactgtataactgctctgccaaagatactttcaagctgaaggtaaagccagggaagacgtaccttcttcgcatgatcaatgccgcactcaatgacgagctcttcttcagcatagcaaaccacacagtcacagttgttgatgttgatgctgtttatgtcaagccatttgatgccgagacacttctcattacccctggacaaaccacaaacgttcttctgaaaaccaaacccgactacccaaatgcccaatttttcatgtctgctagaccttacgcgactggtcaaggaactttcgataattcaactgttgctggcattttagaatatgaagtgccaaacaaaaccagtcaatcaaaccactccaccaagaaactcccactctataagccaaatctaccaccactaaacgacacttcatttgctacaaacttttctagcaagctccgcagcttagccagtgcagacttccctgccaatgttcctcaaaaggttgacagacaatttgtcttcactgtaggccttggaacaaacccatgctctaaaaaccaaacctgccagggaccaaacggaacgaggtttgctgcttcagtcaataatgtatcatttgtaatgccatccacagctctactccaagcccaccattttggtcaatcaaggggtgtttacagtccttatttcgcaatcagtccactgatcccttttaactatactggcacaccaccgaacaatactatggtgagcaatggaacaaagctagttgttcttcctttcaacacaagcgtggagctcatcatgcaggacaccagcatacttggtgctgagagccaccctcttcatttgcatggtttcaatttctttgttgtcggtcaaggttttgggaactttgatccaagcaaggatcccgcaaatttcaatcttgttgaccccgttgaaaggaatactgtgggagtgccctctggaggctgggttgctatacggtttctagcagacaatccaggcgtatggttcatgcattgccatctagaagtgcacacaagctggggcttgaagatggcttgggttgtcttggatggaaagcttcccaatcagaagctgcttcctccaccagctgatcttcccaagtgt

SEQ ID NO: 165 - protein, 570 aa, Populus trichocarpa
LAVFLFSFVTLSVNPEPALAITRHYKFDVMLQNVTRLCHTRSMVTVNGKFPGPRIVAREGDRLVIRVVNHVQNNISIHWHGIRQLRSGWADGPAYVTQCPIQTGQSYVYNYTIVGQRGTLWWHAHISWLRSTLHGPIILLPKLGTPYPFAKPYKEVPIIFGEWFNADPEAIISQAMQTGGGPNVSDAYTINGLPGPLYNCSAKDTFKLKVKPGKTYLLRMINAALNDELFFSIANHTVTVVDVDAVYVKPFDAETLLITPGQTTNVLLKTKPDYPNAQFFMSARPYATGQGTFDNSTVAGILEYEVPNKTSQSNHSTKKLPLYKPNLPPLNDTSFATNFSSKLRSLASADFPANVPQKVDRQFFFTVGLGTNPCSKNQTCQGPNGTRFAASVNNVSFVMPTTALLQAHHFGQSRGVYSPYFPISPLIPFNYTGTPPNNTMVSNGTKLVVLPFNTSVELIMQGTSILGAESHPLHLHGFNFFVVGQGFGNFDPSKDPANFNLVDPVERNTVGVPSGGWVAIRFLADNPGVWFMHCHLEVHTSWGLKMAWVVLDGKLPNQKLLPPPADLPKC

SEQ ID NO: 166 - DNA, 1710 bp, Populus trichocarpa
ctggcagtgtttctcttctcatttgtcactttgtctgtcaatcctgagcctgcacttgccattactaggcactacaaatttgatgttatgctgcaaaatgtgacacgcctttgccataccaggagcatggttacagtcaatgggaagttcccggggcctcgcattgtagctagagagggtgatcgtcttgttattagagtggtcaaccatgtccaaaacaacatctctattcactggcatgggattcgacagcttcgcagcgggtgggccgacggaccagcatacgtaactcagtgccccatacaaactggacaaagctatgtgtacaactacaccattgtaggacagagaggcactctttggtggcatgcccatatatcatggttaagatcaactctccacggtccaataatccttcttcccaaactcggcacaccttacccatttgctaaaccttacaaggaggttccaatcatctttggggagtggtttaatgcagatccagaggcgatcattagtcaggcaatgcaaactggtggaggcccaaatgtctctgatgcttatactatcaatggacttccagggccattgtataactgctctgccaaagatactttcaagctgaaggtaaagccagggaagacttaccttcttcgcatgatcaatgctgccctcaatgacgagctcttcttcagcatagcaaaccacacagtcacagttgttgatgttgatgctgtttatgtcaagccatttgatgccgagacacttctcattacccctggacaaaccacaaatgttcttctgaaaaccaaacccgactacccaaatgcccaatttttcatgtctgctagaccttacgcgactggtcaaggaactttcgataattcaactgttgctggcattttagaatatgaagtgccaaacaaaaccagtcaatcaaaccactccaccaagaaactcccactctataaaccaaatctaccaccactaaacgacacttcatttgctacaaacttttctagcaagctccgcagcttagccagtgcagacttccctgccaatgttcctcaaaaggttgacagacaatttttcttcactgtaggccttggaacaaacccatgctctaaaaaccaaacctgccagggaccaaacggaacgaggtttgctgcttcagtcaataatgtatcatttgtaatgccaaccacagctctactccaagcccaccattttgggcaatcaaggggtgtttacagtccttattttccaatcagtccactgatcccttttaactatactggcacaccaccgaacaatactatggtgagcaatggaacaaagctagttgttcttccttttaacacaagcgtggagctcatcatgcagggcactagcatacttggtgcagagagccaccctcttcatttgcatggtttcaatttctttgttgtcggtcaaggttttgggaactttgatccaagcaaggatcccgcaaatttcaatcttgttgaccccgttgaaaggaatactgtgggagtgccctctggaggctgggttgctatacggtttctagcagacaatccaggcgtatggttcatgcattgccatctagaagtgcacacaagctggggcttgaagatggcttgggttgtcttggatggaaagcttcccaatcagaagctgcttcctccaccagctgatcttcccaagtgt

SEQ ID NO: 167 - protein, 182 aa, Arabidopsis thaliana
MAKRFLLLLPLLSSILLLAVSVTAYSTTTPYQGYKPEKFTHLHFYFHDVISGDKPTAVKVAEARPTTTLNVKFGVIMIADDPLTEGPDPSSKEVGRAQGMYASTAMKDIVFTMVFNYVFTAGEFNGSTIAVYGRNDIFSKVRELPIIGGTGAFRFARGYALPKTYKIVGLDAVVEYNVFIWH

SEQ ID NO: 168 - DNA, 549 bp, Arabidopsis thaliana
atggctaaacgttttctgcttcttcttcctcttttgtcatctattcttcttcttgccgtgtccgtcacagcttactccacaacaacgccgtatcaaggctacaagccggagaaattcacccacctccacttctacttccatgacgtcatctccggtgacaaacctaccgccgtcaaagttgccgaagcccgcccaacaaccaccctcaacgtcaagtttggcgtgattatgatcgctgatgatccgttgaccgaaggaccagacccgagctcaaaggaagtgggaagagctcaggggatgtacgcatcaacagccatgaaggacatagtcttcacaatggtctttaactatgttttcacggcaggagagtttaatggaagcaccatcgcggtgtatggacggaatgatatattttcgaaggtgagagagttgccgattattggaggaactggtgctttcaggtttgctagaggctatgcactgcccaagacttataagattgttggtctagatgccgtggtcgagtataatgtcttcatttggcattaa

SEQ ID NO: 169 - protein, 189 aa, Medicago truncatula
MKNIFTLFFILFLCLSINLIHCEYFYSESIVPHELPNKVTHLHFYYFDIHTGNNPSAVVVARANQTSDIPKKHSLFGTVYAIDNPLREGPEETSNVVGNAQGLYVASSQSEDVTLTMYVDYAFTSGELNGSSFSVLSRNPVREPTRELAVVGGRGKFRMATGFAQIRAHFLNATTGDGIVEYNVTVFHY

SEQ ID NO: 170 - DNA, 570 bp, Medicago truncatula
atgaaaaacatattcaccctattttttatcctattcctctgcctaagtatcaacttgatccattgtgaatacttttattctgagagtatagttccacatgagctaccaaataaggtaactcaccttcatttctactactttgatattcacacaggcaataacccaagtgcagttgttgtggcacgtgctaaccaaacaagtgacattcctaagaaacattcattgtttggtactgtttatgccattgacaatcctcttagggaaggtcctgaagaaacatcaaatgtagttggaaatgcacaaggtctttatgtggcatctagccagagtgaagatgtgacacttactatgtatgttgattatgctttcacctctggtgaattaaatggaagctcctttagtgttctttcgaggaatccggtgagggaaccgacgagggaactcgcggtggtcggaggaagaggaaagtttaggatggccactggttttgctcagattagggctcattttcttaatgctacaactggtgatgggatcgttgagtataatgtaactgtttttcattattaa

SEQ ID NO: 171 - protein, 229 aa, Oryza sativa
MAPTSRSPAALFLLLALACAAPPLLRAADTHLHFFMHDVVSGSGQTAVQVIKGPTSANGGVSTGFGDTTVVDDALTETSSATSPEVGRAQGFYMMSSLSSPTLMMCVNLYFTAGENNGSTIAVIGHDDTTATVRELSVVGGTGKFRMATGYVVWKTASMSASTGVFELDVYVTTPNATTIDASAPVSPLDGGGSSGSTSTAKSGAAGRQVGWVSACVVGLVVALVGRGW

SEQ ID NO: 172 - DNA, 1338 bp, Oryza sativa
gacatcaactaaattaacccaagtaggatgcatttttcttgacctgaatcatgcttgctttgcagcatgcatgcctgccgtaaagtctaagcttcacatggttattattagttaattaatagtagaaataatatagtcatttctgctacctactcccactttctgagagaatacctgttgataaattaaacttcctgtgggcagcagcagcagctagtgttcgtccagtccaggttcagccatggcgcccacctctcgctctcccgccgccctcttcctgctgctcgcgctcgcctgcgccgcgccgccgctcctgcgggcggcggacacgcacctccacttcttcatgcacgacgtcgtctccggcagcggccagacggcggtgcaggtcatcaagggcccgacgtcggccaacggtggcgtcagcaccggcttcggagacaccaccgtcgtcgacgacgcgctcacggagacctcgtcggcgacgtccccggaggtggggcgcgcgcaggggttctacatgatgtcgtcgctgtcgagcccgacgctgatgatgtgcgtgaacctctacttcaccgccggcgagaacaacggcagcaccatcgcggtgatcggccacgacgacaccacggccacggtgagggagctgtccgtggtgggcggcacgggcaagttcaggatggccaccggctacgtggtgtggaagacggccagcatgagcgccagcaccggcgtgttcgagctcgacgtctacgtcaccacgcccaacgccacaaccatcgacgcctccgcgccggtgtcgccgttggacggcggaggcagcagcgggtcgacgtcgacggcgaagtcgggcgcggcggggcgacaggtggggtgggtgagtgcgtgcgtagtggggttggtggtggcgttggttgggcgtggttggtgaggcgtcgagtcgtcggtgtccaagagattcgttggtgccttctctttgttttcgagtcttttagtttgttggaatcggattcccgtactgaacctgcttttactgcaagttaattgtttggttggttggttgccttcctgtcactccaccttgaccgtgaaggtattactgtactgcagcataaaggtccccaccttgaccaccatcttcaccatctatctatacattttattttcacaataaagatggtcaattatttagttttatctcctaaaattctttgatatggcttatatgtattattttttatagaaaatcccttttaaatctttcaaatatgaatatagtatagtttttttaggacaccgggggatatagtatagtatagtataattttgactcccgca

SEQ ID NO: 173 - protein, 184 aa, Populus trichocarpa
MASHVACTLFTLHFILFSYLCTITCGAFYEEVTEAIAIKRIEKTTHLHFYFHDIVSGKNPTAIRIAGPDNYAFGNTMMADDPLTEGLEISSKPVGKAQGLYAFASQNDFCLLMVMNFAFTEGKYNGSSISILGRNQILNDVREMPIVGGSGLFRLAHGYALAHTVWFDEQGDATVEYNVYVSHY

SEQ ID NO: 174 - DNA, 601 bp, Populus trichocarpa
agtccagtctagccataaagaacacacttgatcacacaatcacaaaatggcttctcatgtggcttgcactctcttcacccttcacttcatcctattctcatatttgtgcacaatcacttgtggggctttctatgaggaagtaactgaagccatagctatcaagcgcatagaaaagaccacacacctacatttctacttccatgacattgttagtggaaaaaatccaacagctattagaattgccggcccggataattatgcctttggtaacacaatgatggcggatgatccgttgacggaagggcttgaaatttcttcaaagcctgttggaaaagctcaaggactctatgccttcgcctcgcaaaacgatttttgtttgctaatggttatgaattttgcttttacagaaggtaaatataatggaagtagtattagcatccttggaaggaaccaaatcctgaatgatgtgagggaaatgccaatcgttggaggtagtgggctatttaggcttgctcatggctacgcattggcacatacagtttggtttgacgagcaaggtgatgctactgtcgaatataatgtgtatgtgtcacactactga

SEQ ID NO: 175 - protein, 149 aa, Populus trichocarpa
KATRIQFYMHDVISGPNPTSVRVAGPDNSTISPNATAALFGPIYMMDNPLTVTPDPNSTVVGRAQGIYGMSSQNELSLLMSFTVGFISGPYNGSTFSVLGRNPIMNEVREMPVVGGTGIFRLARGYCLAKTHSMVGFDAIIGYNVTLLH

SEQ ID NO: 176 - DNA, 447 bp, Populus trichocarpa
aaagccactcgtatccaattctacatgcacgatgttattagcggtccaaatccaacttctgtcagggttgcaggccctgataactccaccatcagcccaaatgcaactgctgccttgttcgggcctatttacatgatggacaacccgctcacagtcacacccgacccgaactccacagttgtaggacgtgcacaagggatttatggtatgtcatcacagaacgagctcagccttctaatgtcattcactgttgggttcattagcggaccttacaatggcagcacgtttagtgtgcttggccggaatccgatcatgaatgaggtgagagaaatgcctgtcgtcggtggcaccgggatcttcaggcttgcccgtggatattgcctggcgaagacccactcgatggttggatttgatgccatcattggatacaatgtgacattgttacac

SEQ ID NO: 177 - protein, 514 aa, Arabidopsis thaliana
MDLKLNTKLIILITSLAFPFMLYALFKWFLKEQGSLAATKLPQSPPALPFIGHLHLIGKVLPVSFQSLAHKYGPLMEIRLGASKCVVVSSSSVAREIFKEQELNFSSRPEFGSAEYFKYRGSRFVLAQYGDYWRFMKKLCMTKLLAVPQLEKFADIREEEKLKLVDSVAKCCREGLPCDLSSQFIKYTNNVICRMAMSTRCSGTDNEAEEIRELVKKSLELAGKISVGDVLGPLKVMDFSGNGKKLVAVMEKYDLLVERIMKEREAKAKKKDGTRKDILDILLETYRDPTAEMKITRNDMKSFLLDVFMAGTDTSAAAMQWAMGQLINHPQAFNKLREEINNVVGSKRLVKESDVPNLPYLRAVLRETLRLHPSAPLIIRECAEDCQVNGCLVKSKTRVLVNVYAIMRDSELWADADRFIPERFLESSEEKIGEHQMQFKGQNFRYLPFGSGRRGCPGASLAMNVMHIGVGSLVQRFDWKSVDGQKVDLSQGSGFSAEMARPLVCNPVDHFNTF

SEQ ID NO: 178 - DNA, 1685 bp, Arabidopsis thaliana
acgtcacacattttatatttggtaaaaggtcacatctgttgttttgttttctttacaatgagcatctaataaacaagattcgtctgtgtctggatataaatacaagcatacttcaaaaattgtatcaatacctgcctgcaatggatttaaaactaaacactaaactaattattctcatcacatccttagcttttcctttcatgctttatgctctcttcaaatggttcttgaaagagcaaggttcattggctgctacgaagctgccacagagccctccagctttaccattcattggccaccttcatttgataggcaaagtattgcctgtctcattccaaagtttagctcacaagtatggcccactcatggagatacgtctcggtgcttctaagtgcgttgtggtctcaagctcttcggtggcgagagagattttcaaggagcaagagcttaatttctcctcgagacctgagtttggttctgcagagtatttcaagtatagagggtccaggtttgtccttgcgcagtatggagattactggaggttcatgaagaagctgtgcatgactaagcttcttgctgttccacagctggagaaattcgctgacatccgtgaggaggagaaactgaagctggtcgattctgtggctaagtgttgcagagaagggttgccttgtgacttgagtagccagttcataaaatacaccaacaatgtaatctgcaggatggcgatgagcaccaggtgttcaggtactgataatgaagcagaagagataagggagctggtgaagaaaagtttggagcttgcggggaagatcagtgtaggagatgtgttggggccattgaaagtaatggacttttctgggaacgggaagaagttagtggctgtaatggagaaatatgacctgcttgtagagagaattatgaaggaacgtgaggcaaaggcaaagaagaaagatggtaccagaaaggatattttggatatattgttggaaacttacagagatcccactgctgaaatgaagataacgaggaatgacatgaaatctttcctgctggatgttttcatggcgggaacagatacatcagcagcagcaatgcagtgggcaatggggcaactaataaaccatccacaagcgttcaacaagttacgagaagagatcaataacgttgttggaagtaaaagactggtgaaagaatcagatgttcctaaccttccttacctccgagctgtcctaagggaaactctgaggctccacccttcagctcctctgatcataagagaatgcgcagaagactgccaggtgaacgggtgccttgtcaagtcaaaaacccgtgtactcgtaaatgtttatgcaatcatgcgagattcagaactatgggcagatgcagacagattcatccccgagagatttctagagagctctgaagagaagataggtgaacaccagatgcagttcaaggggcagaatttccgttaccttccatttgggagtggaaggagaggatgtccaggagcatcccttgccatgaatgtgatgcatataggtgtgggttcattggtgcagcgcttcgactggaagagtgttgatggacagaaggtcgatctgagccaaggttctggtttttctgctgagatggctcgaccacttgtgtgcaatcctgtggatcactttaacaccttctaa

SEQ ID NO: 179 - protein, 511 aa, Medicago truncatula
MVDYQGYILLFIIWLVSTIFVKAILTRKYKKSKLPPSPLSLPIIGHLHLIGSIPHQGLHKLSTKYGPIIHLFLGSMPCVVASTPESAKEFLKTHETYFSNRPQSSAVDYLTYGSQDFSFAPYGPYWKFIKKICMSELLGGNTLSQLLPLRRQETTRFVSFLLKKGKENEVIDVGRELLKLSNNVISRMIMSQTCSENDGEAEEVRKLVQDTVHLTGKFNISDFIWFFKNWDVQGFSKGLEEIRDRFDSMMERIIKEHQEVRRRRKEVGGGEGQIKDLLDILLDILEDESSEIKLKMENIKAFILDIFIAGTDTSALTIEWALAELINNPHMMEIARQEINDVVGNNRIVEESDIINLPYLQAIVKETLRIHPTGPLIVRESSEKCTIQGYEIPAKTQLFVNIWSIGRDPNYWDNPLEFRPERFINEVGNLDVRGQHFHLIPFGSGRRACPGTSLALHVVQTNLAAMIQCFEWKVKGGNGIVNMEEKPGLTLSRAHPLICVPVPRFNHFPSM

SEQ ID NO: 180 - DNA, 1536 bp, Medicago truncatula
atggttgattaccaaggttacatcttacttttcatcatatggctagtatcaacaatttttgtaaaagccatactcacaagaaaatacaagaaatcgaagttacctccaagtccattatctttaccaatcattggacatcttcaccttattggttcaatacctcaccaaggacttcacaaactttcaacaaaatatggacctataatacaccttttcctaggttccatgccttgtgttgtagcttccacaccagaatccgctaaagagtttcttaaaactcacgaaacctatttctccaaccgtcctcaaagttcagctgttgattatctaacatatggctcacaagatttttcctttgctccatatggaccttattggaaatttatcaagaaaatatgcatgtctgaacttcttggtggtaacacattgagtcaacttcttcctttaaggagacaagagacaacaaggtttgttagttttttgctcaagaaagggaaggagaatgaggttattgatgttggaagagagcttttgaagttgtcgaataacgttatttcaaggatgattatgagccaaacttgtagtgaaaatgatggtgaagctgaagaggtgaggaagttggtgcaagacactgtacatcttacggggaagtttaatatttctgattttatttggttttttaagaactgggatgtccaggggtttagcaaagggttagaggaaattagggacaggtttgattctatgatggagaggattatcaaggagcatcaagaagtaaggaggaggagaaaagaagttggtggaggagaaggtcaaattaaggatctacttgatattttattggatattcttgaagatgagagctctgaaatcaaattgaaaatggagaacataaaagccttcatcttggacatatttattgctggaacagacacttcagccctaaccatagaatgggcactggcagagctaattaacaacccacatatgatggaaatagcaagacaagagatcaatgatgtagttggaaataatagaatagtagaagaatcagacattatcaaccttccttacctacaagcaatagtcaaagaaacactaaggattcacccaacaggtccattaattgttagagaatcatctgaaaagtgcacaatccaaggctatgagataccagcaaagacacaattgtttgttaatatatggtctattggaagggaccctaattattgggataatccacttgagtttaggccagaaaggtttattaatgaagttggaaatttagatgtgaggggtcaacattttcatttgattccatttgggagtggaagaagagcatgccctggaacatcattggctttgcatgttgtgcaaacaaatcttgctgctatgattcaatgttttgaatggaaggttaaaggtggtaatgggattgttaatatggaagagaaacctgggttgaccctttcaagggctcatcctttaatttgtgtccctgtgcctagatttaatcattttccttctatgtga

SEQ ID NO: 181 - protein, 516 aa, Oryza sativa
MASLMEVQVPLLGMGTTMGALALALVVVVVVHVAVNAFGRRRLPPSPASLPVIGHLHLLRPPVHRTFHELAARLGPLMHVRLGSTHCVVASSAEVAAELIRSHEAKISERPLTAVARQFAYESAGFAFAPYSPHWRFMKRLCMSELLGPRTVEQLRPVRRAGLVSLLRHVLSQPEAEAVDLTRELIRMSNTSIIRMAASTVPSSVTEEAQELVKVVAELVGAFNADDYIALCRGWDLQGLGRRAADVHKRFDALLEEMIRHKEEARMRKKTDTDVGSKDLLDILLDKAEDGAAEVKLTRDNIKAFIIDVVTAGSDTSAAMVEWMVAELMNHPEALRKVREEIEAVVGRDRIAGEGDLPRLPYLQAAYKETLRLRPAAPIAHRQSTEEIQIRGFRVPAQTAVFINVWAIGRDPAYWEEPLEFRPERFLAGGGGEGVEPRGQHFQFMPFGSGRRGCPGMGLALQSVPAVVAALLQCFDWQCMDNKLIDMEEADGLVCARKHRLLLHAHPRLHPFPPLL

SEQ ID NO: 182 - DNA, 1927 bp, Oryza sativa
gaaacagatcagtaaggtaggatggcatcgttgatggaagtgcaggtgccgctgttgggaatgggcactacgatgggcgccctggctctggctctcgtcgtcgttgtggttgtgcacgttgccgtgaacgcctttgggcggcggcggcttcccccgagtccggcgagcctaccggtgatcgggcaccttcacctgctccggccgccggtgcaccgcaccttccacgagctggcggcgaggctgggccccctgatgcacgtccggctggggtcgacgcactgcgttgtggcgagctcggcggaggtggcggcggagctgatccgcagccacgaggcgaagatatcggagcggccgctgacggcggtggcccggcagttcgcgtacgagtcggcggggttcgcgttcgcgccctacagcccgcactggcgcttcatgaagcggctgtgcatgtcggagctgctgggcccgcgcacggtggagcagctgcgccccgtgcgccgagccgggctggtgtcgctgctgcgccacgtgttgtcgcagccggaggcggaggcggtggacctgacccgcgagctcatccgcatgtccaacacctccatcatccgcatggccgccagcacggtccccagcagcgtgacggaggaggcgcaggagctggtgaaggtggtggcggagctggtgggcgccttcaacgccgacgactacatcgccctgtgccgtggctgggacctgcagggcctcgggcgccgtgcggccgacgtgcacaagaggttcgacgcgctgctggaggagatgatcaggcacaaggaggaggctaggatgcggaagaagacagacacagacgtcggcagcaaggacctgcttgacatcctgctggacaaggcggaggacggcgcggcggaggtgaagctcaccagagacaacatcaaggccttcatcatcgacgttgttactgccgggtccgacacttcggccgccatggtggagtggatggtggcggagctgatgaaccacccggaggccctgcgcaaggtgcgggaggagatcgaggcggtggtggggcgggacaggatcgccggcgagggggacctgccgagactgccgtatctgcaggcggcgtacaaggagacgctgcggttgaggccggcggcgccgatcgcgcacaggcagtcgacggaggagatccagatccgagggttcagggtgccggcgcagacggcggtgttcatcaacgtgtgggccatcgggcgagacccggcgtactgggaggagccgctggagttcaggccggagcggttcctcgccggcggcggcggcgagggcgtggagccgcgcgggcagcacttccagttcatgccgttcgggagcggccggcgcgggtgccccgggatggggcttgcgctgcagtcggtgccggcggtggtggcggcgctgctgcagtgcttcgattggcagtgcatggacaataagttgatagacatggaggaggcagacggcctggtttgcgctcggaagcatcgcctcctcctccacgcccacccgcgcctccaccctttcccgccgctcctctagctacccctacctacctaccactcctactcctttcctgtccctgtaacgcaccgtaatacaaccattataaattaattaccactttactatattgtaataattaatgtgtatgtattccctacctagacctattgcatgtctctcaaatcaaatattccaagcaagcttgattgtgatacagatgggacagatttcagagctactagcaaattagtatattgttgacagtcgtcacagcacgggcagattatattagtcaacgaaccacaggatacgctaccttccacagtactcctaattaaatgtaccacctatttagacatttggctcctaaattttgacaaattggctccgc

SEQ ID NO: 183 - protein, 502 aa, Populus trichocarpa
LFLLWLLSTILVRAILNKTRAKPRLPPSPLALPIIGHLHLLAPIPHQALHKLSTRYGPLIHLFLGSVPCVVASTPETAKEFLKTHENSFCDRPKSTAVDFLTYGSADFSFAPYGPYWKFMKKICMTELLGGRMLDQLLPVKHEEIRQFLQFLLKKANARESIDVGSQLIRLTNNVISRMAMSQRCSDNDDEADEVRNLVHEVADLTGKFNLSDFIWFCKNLDLQGFGKRLKEVRKRFDTMTERIIMEHEEARKKKKETGEGDPVKDLLDILLDISEDDSSEMKLTRENIKAFILDIFAAGTDTSAVTMEWALAELINNPNILERAREEIDSVVGQSRLVQESDIANLPYVQAILKETLRLHPTGPIILRESSESCTINGYEIPARTRLFVNVWAINRDPNYWENPLEFEPERFLCAGENGKSQLDVRGQHFHFLPFGSGRRGCPGTTLALQMVQTGLAAMIQCFDWKVNGTVDMQEGTGITLPRAHPLICVPVARLNPFPSF

SEQ ID NO: 184 - DNA, 1506 bp, Populus trichocarpa
cttttcctattatggctactctccaccattttggtcagagcaatactaaacaagactcgagccaaacctcgccttccaccgagcccattggccttaccaatcattggacacctccatctccttgccccaataccccaccaagctcttcataagctctcaacccggtatggaccattgattcatttattccttggttctgtcccttgtgttgttgcttctacacctgagactgcaaaggagttcctcaaaactcatgaaaattctttctgcgatcgtcctaagtcaaccgcagtcgattttctaacatatggatcagctgatttctcatttgccccttatggaccttactggaaattcatgaagaaaatttgtatgactgaacttcttggaggtcgaatgttagaccagcttcttccagttaagcatgaagagattaggcagtttttacagttcttgctaaagaaagcaaatgcaagagagtcaattgatgttggaagtcaacttataaggctaactaataatgttatatcgagaatggcaatgagccaaaggtgttcagataatgatgatgaagcagatgaggtcaggaatttggtgcatgaggtagctgatcttacagggaagtttaatttgtcagattttatttggttttgcaagaacttggatttgcagggatttggaaaaaggctgaaggaagtccgcaaaaggttcgacacgatgacggaaaggatcataatggagcatgaagaggcgaggaagaaaaagaaagaaactggtgaaggtgaccccgtgaaggatctacttgatattttacttgatatatcagaagatgatagctcagaaatgaaattgaccagagaaaatatcaaggcgttcatactggacatattcgcggcggggacagacacctctgctgttaccatggaatgggcactagcagagctcatcaataacccaaacatcttggagagagcaagagaagagatagattctgttgtaggacaaagcagactagtacaagaatcagacatcgctaacctgccctacgttcaagctatactaaaggaaacactgaggcttcaccccactggtccaataattctgagggaatcaagtgaaagctgcaccatcaatggctatgaaattccagcaagaaccaggctattcgttaacgtgtgggctattaatagagatccaaactactgggagaacccacttgagttcgaaccggaaaggtttctttgcgcaggagaaaatggaaagagtcagctggatgtgaggggtcagcattttcactttcttccatttgggagtggaagaagagggtgccctggaactacactggcacttcaaatggttcaaacaggccttgctgctatgattcaatgctttgattggaaagttaatggcactgttgacatgcaagaaggaactggtataacacttccaagggcccatcccttaatttgtgtcccagtggcaaggctcaatccatttccatcgttc

SEQ ID NO: 185 - protein, 511 aa, Medicago truncatula; identical to SEQ ID NO: 179

SEQ ID NO: 186 - DNA, 1536 bp, Medicago truncatula; identical to SEQ ID NO: 180

SEQ ID NO: 187 - protein, 516 aa, Oryza sativa; identical to SEQ ID NO: 181

SEQ ID NO: 188 - DNA, 1927 bp, Oryza sativa; identical to SEQ ID NO: 182

SEQ ID NO: 189 - protein, 502 aa, Populus trichocarpa; identical to SEQ ID NO: 183

SEQ ID NO: 190 - DNA, 1506 bp, Populus trichocarpa; identical to SEQ ID NO: 184

SEQ ID NO: 191 - protein, 577 aa, Arabidopsis thaliana; identical to SEQ ID NO: 157

SEQ ID NO: 192 - DNA, 2049 bp, Arabidopsis thaliana; identical to SEQ ID NO: 158

SEQ ID NO: 193 - protein, 585 aa, Medicago truncatula; identical to SEQ ID NO: 159

SEQ ID NO: 194 - DNA, 1758 bp, Medicago truncatula; identical to SEQ ID NO: 160

SEQ ID NO: 195 - protein, 579 aa, Oryza sativa
MTMAISSALPSPLLLAASLLLLIVQAQGITRHYEFNVQMANATRLCNTKSMVTVNGQCPGPELVAREGDRVVIRVTNNVAHNISLHWHGVRQVRTGWADGPAYITQCPIQTGQSYVYNFTVAGQRGTLWWHAHISWLRATVYGALVILPKLGVPYPFPAPHKEVPVIFGEWWNADTEEVVNQAVQTGGGPNVSDAFTINGLPGPLYNCSAQDTFKLKVKPGKTYMLRLINAALNEELFFAVANHTLTVVEVDAVYVKPFTVDTLVISPGQTTNVLLTAKPYYPGANFYMSAAPYSTARPGTFGNTTVAGILEYENPAMSPSAASFVKGLPLFKPTLPQLNDTDFVTNFTDKLRSLATPEYPAAVPQSVDKRFFFTVGLGTLPCPANMTCQGPNNTQMAASMNNVSFVLPARALLQSHFTGLSSGVYAPDFPVAPLSPFNYTGTPPNNTNVKTGTKLLVLRYNTSVELVMQDTSILGIESHPLHLHGFNFFVIGQGFGNYDAVNDPAKFNLVDPVERNTVGVPAGGWVAIRFLADNPGVWFMHCHLEAHTTWGLRMAWLVLDGSHPNQKLLPPPSDLPKC

SEQ ID NO: 196 - DNA, 2043 bp, Oryza sativa
aacattcattccatccttgccaggccatctcccactcaaagtctcacagagctagctgatcaagagccattacagattgtggctcaaagcttaggctacacaaattaagatgaccatggctatctcctctgctcttcctagccctctactcttggcggcttccctactgcttctcatcgtccaagctcagggcatcactaggcactacgaattcaatgtgcaaatggcgaacgcgacgaggctgtgcaacaccaagagcatggtgacggtgaacgggcagtgccccgggccggagctggtggcgagggaaggcgaccgcgtcgtcatccgcgtcaccaacaacgtcgcgcacaacatctcgttgcactggcacggcgtccggcaggtgcggaccgggtgggcggacgggccggcgtacatcacgcagtgcccgatccagacggggcagagctacgtgtacaacttcacggtggccgggcagcgcggcaccctgtggtggcacgcccacatctcctggctccgcgccaccgtctacggcgccctcgtcatcctccccaagctcggcgtcccctaccccttccccgccccgcacaaggaggtccccgtcatcttcggcgagtggtggaacgcggacacggaggaggtggtcaaccaggcggtccagaccggcggaggcccgaacgtctccgacgccttcaccatcaacggcctccccggccctctctacaactgctctgcccaagacacgttcaagctgaaggtgaaacccgggaaaacgtacatgctgcgcctcatcaacgccgcgctcaacgaggagctcttcttcgccgtcgccaaccacacgctcaccgtcgtcgaggtcgacgccgtctacgtcaagccgttcaccgtcgacaccctggtgatctcgccggggcagaccaccaacgtgctcctcaccgccaagccgtactaccccggcgccaacttctacatgtccgccgcgccctactccaccgccaggcctgggaccttcggcaacacgaccgtcgccggcatcctcgagtacgagaaccccgccatgtcgccctccgcggcgagcttcgtcaagggcttgccgctgttcaagccgacgctgccgcagctcaacgacaccgacttcgtcaccaacttcaccgacaagctccgtagcctcgcgacgccggagtacccggcggccgtgccgcagtcggttgacaagcgattcttcttcacggtcgggctgggcacgctgccgtgcccggcgaacatgacctgccagggccccaacaacacgcagatggcggcgtccatgaacaacgtctccttcgtgctcccggcgagggcgctgctgcagtcccacttcaccggactctccagcggcgtgtacgcgccggacttccccgtcgcgccgctgtcgccgttcaactacacggggacgccgccgaacaacaccaacgtgaagaccgggaccaagctgctggtgctgcggtacaacacgtcggtggagctggtgatgcaggacaccagcatcctgggcatcgagagccacccgctgcacctgcacggcttcaacttcttcgtgatcggccaagggttcggcaactacgacgccgtgaacgacccggccaagttcaacctcgtcgaccccgtcgagcgcaacaccgtcggcgtgccggccggcggatgggtggccatccgtttcctcgctgacaacccaggtgtatggttcatgcactgtcatttggaggcgcacacgacgtggggcctgaggatggcatggctagtgttggatgggagccatccgaaccagaagctgcttcctccgccgtccgatctgcccaaatgctagtcgggaccttaccacagatgccgttgattcttctttcctcatttcatttgttcgccaatttgcgattgctttctcctgaaggagattttagtgtgttagcccgttcttagctaacttttgtgacattattttgttcttttttcttttatttgtgtacaactatacaatgacactgttttgatgcttctttgaat

SEQ ID NO: 197 - protein, 570 aa, Populus trichocarpa; identical to SEQ ID NO: 165

SEQ ID NO: 198 - DNA, 1710 bp, Populus trichocarpa; identical to SEQ ID NO: 166

SEQ ID NO: 199 - protein, 369 aa, Oryza sativa
MARVSAAAVAVLVVAFAAAAAAQESCNTELPGVLVGNYSGLNCQPVWNNFVLRYHQDKNNVLRVVLSTMYSTGWVGMGFSRDGLMVGSSAMVGWIGRKGLPHVKQFALRGKTSGKVVVNRGFLVSNSNNHDHTVVVQQARIYLAFQLQFSYRLTHQHIILAFGSSIPVNNKLTKHQDKTSFTFDFTTGKAFVDGSFPYGLRRAHGALNLFAWGVLMPIGAILARYFRRMDPLWFYLHVGVQFVAFIIGLAGVVAGVALYNKIQADIPAHRGLGIFILVLGILQILAFFLRPNTDSKYRKYWNWYHHWSGRLVLFFAAVNIVLGIHVGGGDNSWKIGYGFNLAIILLAVIGLEFMLRTRWSKESEPTPTY

SEQ ID NO: 200 - DNA, 1554 bp, Oryza sativa
actgcaacctctcatcaaccggctctctcctcctcctaaaccgggcagcttctctctctcgcgttgctgccgcgcgcggggcacacagctaagctagtgtcgccattgccattgtcttggaaggaggttggttagcatggctcgcgtgtcggcggcggcggttgccgtgctggtggtggcgttcgcggcggcggcggcggcgcaggagagctgcaacaccgagctgccgggcgtgctcgtcggcaactactccggcctgaattgccagccggtctggaacaatttcgtgctccggtatcaccaagacaagaacaacgtgctgagggtggtgctgtcgacgatgtacagcacggggtgggtggggatggggttctcccgggacggcctcatggtgggctcgagcgccatggtcgggtggatcgggcggaagggcctcccgcacgtcaagcagttcgcgctgcgcggcaagacgagcggcaaggtggtcgtcaaccgcggcttcctcgtctccaactccaacaaccacgaccacaccgtcgtggtgcagcaggccaggatctacctcgcgttccagctccagttctcctaccgactcacccaccagcacatcatcctcgccttcggctcctccatccccgtcaacaacaagctcaccaagcaccaggacaagacatccttcaccttcgatttcaccactggtaaagctttcgtggacgggtcgttcccctacggtctgaggagggcacacggtgctctgaacctgttcgcgtggggcgtcctgatgccgatcggcgccatcctggcgcgctacttccggcggatggaccctctctggttctacctccacgtcggcgtccagttcgtcgccttcatcatcggcctcgccggcgtcgtcgccggagttgccctctacaacaagatccaggccgacatcccggcgcacaggggcctcggcatcttcatcctcgtcctcggcatccttcagattttggcgttcttcctgcggccgaacacggactccaagtaccggaagtattggaactggtaccaccactggtcgggcaggctggtgctgttcttcgccgccgtcaacatcgtgctcggtatccacgtcggcggcggggacaactcgtggaagatcgggtacggcttcaacctcgccatcatcctcctcgccgtcatcgggctggagttcatgctgcggacgaggtggtccaaggaaagcgagcccacgccgacgtactaggcgcggcgccggcggccgccgttgatgccgcgaacccactattttttggttttttttttgtgcccttgggcgctggactgtgtcttagctctggtggtgttgtgattgttttttggccttctgtgctgttcgattttctgcatgttgctgtcaagtgaaactgtgaaaaagtgtaagcgtgagcaggtgcaattgcactatgccacaattgataggttttcgtttttgtttctgagatgcactgtcctgaggtgtaagaccacttgcttagcagaaaaagtcaatgacggtcatggtgcataggacaa

SEQ ID NO: 201 - protein, 394 aa, Oryza sativa
MAGAVVLALLLLLAAMAAASVAAAGGCAGEAFSANRAYAACSDLPRLGASLRWTYDRGAGGELSVAFVAAPAAPGGWVAWGLNPAGDGMAGAQALVAVPSSSGAWEVRTYNISGYALGEPGPIAFPASDLAAELGADGRVRVFGTLSLAAYGGAGVLNQVWQVGPAVTGGVPAPHAMGGANLAAKAKLDLLTQTTTAASSSSDAIAKKRNIHGLLNAVSWGILLPMGAILARYLKTFRSADPAWFYLHVSCQLIGYGVGVAGWATGINLGNMSNGITYTLHRNIGIIVFALGTLQIFALFLRPKKENKYRVYWNMYHHSVGYTVIILGITNIFKGMTILGVEQRWKTAYVAVLCLLGVAAIILEVVTWGMVVKRRNAESKTFNSASNGHLPRHV

SEQ ID NO: 202 - DNA, 1582 bp, Oryza sativa
aaccaccttgcactgcactgtcactcgcggacgccgcgagccgagctgagctacgccatggcgggggcggtggtgctggcgctgcttctgctgctcgcggcgatggcggcggcgtcggtggcggcagccgggggatgcgccggcgaggcgttctcggcgaaccgcgcgtacgcggcgtgcagcgacctgccgcggctcggcgcgtcactgcgctggacgtacgaccgcggcgcgggcggggagctgtccgtcgcgttcgtggcggcgcccgcggcgccgggagggtgggtggcgtgggggctcaacccggccggtgacgggatggccggggcgcaggcgctcgtcgccgtgccgtcgtcgtcgggcgcgtgggaggtccggacatacaacatctccgggtacgcgctcggcgagccggggccgatcgcgttcccggcgtcggacctcgccgccgagctcggcgccgacggccgcgtcagggtgttcggcacgctgagcctcgccgcctacggcggcgccggcgtgctgaaccaggtgtggcaggtcggccccgccgtcaccggcggcgtccccgcgccgcacgccatgggcggcgccaacctcgctgccaaggcgaagctagacctactaacacaaaccaccaccgccgcctcctcctcctccgacgccatcgccaagaagcgcaacatccatggattgctcaacgccgtgagctggggaatcctgctgcccatgggggcgatcttggcgaggtatctcaagaccttcagatcggcggacccggcatggttctacctccatgtgagctgccagctgatcggctatggcgtcggcgtcgccggctgggccaccggcatcaacctcggcaacatgtccaatgggatcacctacactctccaccgcaacatcggcatcattgtctttgctcttggcaccctgcaaatttttgcgctgttcttgaggcccaagaaggagaacaagtacagggtctactggaacatgtaccaccactccgtcggctacacggtgatcatactggggatcaccaacatcttcaaggggatgaccatccttggcgtcgagcagcggtggaagacggcctacgtcgccgtcctctgcctcctcggcgtcgccgccatcatccttgaggtcgtcacatggggcatggtggtgaagaggcgcaatgccgagagcaagaccttcaacagcgcctccaatggccacctgcctcgccatgtgtgattttttttgaagttcttttttggggcttttgtttgtgctgtgacagtgttcattgtggtgtgtactgtagcatatcatagattttcggtcttgtgagttttttggcctgcatatctttttaccatgagcgttatgcatttgtagtacattagagtgaagattgagtgtgtagtgaccagttgcagtgagtatgtttgggtttacatggctaatcccattagatagcttttgagttgagggattttattgtttttggagaggtacagagatgtaccacaaatttttagtattaatttatggtatatttacactaagtgacttcaggatttcagagataaca

SEQ ID NO: 203 - protein, 464 aa, Arabidopsis thaliana
MEDAAEQERGFHVITIRKQIVTAALPLQDHWLPLSNLDLLLPPVQISVCFCYKKPRHFLSVAETLKASLAEALVSYYAFAGELVKNSSGEPEILCNNRGVDFLEAVADVELRELNLHDPDESIAKLVPKKKHGVIAIQVTQLKCGSIVVGCTFDHRIADAFSMNMFLVSWAEISRFNAPISSVPSFRRSILNPRRPLIIDSSIDKMYMPVTSLPLPQETTNDLDNILTSRIYYIKENALEDLQTLASGSSPKTGYGQRTKLESFSAFLWKLVAKHTGRDLVSNKNSKMGIVVDGRRRLMEKEDNTYFGNVLSIPFGGQSIDDLIDKPLSWVTNEVHRFLEEAVTKEHFLNLIDWVEIHRPIPAVSRIYSTGTDDGPAFVVSSGRSFPVNKVDFGWGLPVFGSYHFPWEGSSGYVMPMPSPVDDGNGDWVVYLHLTKGQLKFIEEEASHVLKPIDNYYLKINTIN

SEQ ID NO: 204 - DNA, 1395 bp, Arabidopsis thaliana
atggaagatgcagcggagcaagaacgtggtttccacgtgatcaccataaggaagcagatagtcacggctgctcttcccctccaagaccattggcttcctctttcaaacctcgacctcctcctccctcctgtccaaatcagcgtttgcttctgctacaagaaaccacgtcatttcttatccgtggctgaaaccctaaaagcgtctttggctgaggctctcgtctcctactatgcctttgccggtgaactcgtgaaaaactcctctggagaacccgagattctctgcaacaaccgcggcgtagacttccttgaggcggttgctgacgtggagctccgggagcttaacttgcatgatcctgatgaaagtatcgccaagcttgttccgaagaagaagcatggagttatagctattcaggtaactcaacttaaatgtgggagcatagtggtaggatgcacatttgatcatcgaattgcagatgctttctccatgaacatgttccttgtttcttgggctgagatctctagattcaatgcaccaatctcttctgtcccatcgttccggagatctatactaaacccgcgacgaccactgattatcgactcatctatagacaagatgtatatgcctgtcacgtctttgccccttccacaagaaacaacaaatgacctagataatatcctcacaagccgtatctattacatcaaagaaaatgcgttggaagatctccaaactctagcaagcggtagctcccccaagactggttatggtcagaggacgaaactagagtcgttcagcgcgtttctatggaaacttgtggcgaaacacacaggaagagatctagtttcgaacaagaactcgaaaatgggtattgttgtcgacggaaggagaagacttatggagaaagaagacaacacttactttggaaacgttctttccatcccatttggtggacagagtatcgatgacttgattgacaagccattgtcttgggtgaccaacgaagttcacagattcttggaagaagcagtgaccaaagaacatttcttaaacttgattgattgggttgagattcaccgcccgataccggcagtgtcgaggatctatagtacgggaaccgacgatggaccagcttttgtggtctcctccgggaggagttttccggtgaacaaggttgatttcggttggggcttaccggtttttgggtcataccatttcccatgggagggaagctccggatatgtgatgccgatgccgagtccggtggacgacgggaacggagattgggtggtttacttgcatcttacgaaaggacagttaaagttcattgaggaggaggcttcccatgtgcttaaacccatagacaattattatctcaagattaacaccatcaattaa

SEQ ID NO: 205 - protein, 457 aa, Oryza sativa
MVKEEQGGEVAMAAAAAVTTTVAPALPTQEHRLPLSNLDLLLPPLDVSVFLCYRHPAPSAAALKEALAKALVPFYPLAGEVVANGDGEPELLCSGRGVDFTESVAGEEMRGLRIGMVDERVEKLVPAKKAASVMAVQVTKFKCGGAVVGCTFDHRVCDAYSFNMFLVAWAAAARDGHGGGTAPPPPTIPSFRRSIVAPRDPPPPRSPSTDALIDRLFAPLGSAPPPPDDAAAAAVNRIYRVAAADAASLQDSAGPGRTKLEAFTAHLWQLNARAAAAERERPCCMGVVVDGRGRMFPDGAMRAYFGNVLTIPYGVMGSGELRAAALADVAGDVHRWVAEAATGDHFRGLVDWVEARRPKPAAARAYLGGTGGGDAAACIVSSGMGFPVGEADFGTGAPAFASYHFPWPAGAGYVMPMPSARGDGDWVVYVHVSPELAVAMDEEPTVFRSLDNSYVFG

SEQ ID NO: 206 - DNA, 1374 bp, Oryza sativa
atggtgaaggaagagcaaggtggcgaggtggccatggccgccgccgccgccgtcacgacgacggtggcgccggcgctgccgacgcaggagcaccggctgccgctgtcaaacctggacctcctcctgccgccgctcgacgtcagcgtcttcctttgctaccgccacccggcgccgtccgcggcggcgctcaaggaggcgctggcgaaggcgctggtgccgttctacccgctcgccggcgaggtcgtggccaacggcgacggcgagccggagctgctgtgcagcggccgcggcgtcgacttcacggagtcggtcgccggcgaggagatgcgcgggctgcggattggcatggtggacgagcgcgtcgagaagctggtgcccgccaagaaagccgccagcgtcatggcagttcaggtgaccaagttcaagtgcggcggcgccgtcgtgggctgcaccttcgaccaccgcgtctgcgacgcctactccttcaacatgttcctcgtcgcctgggccgccgccgcccgcgatggtcacggcggcggcaccgcgccgcctccgccgacgatcccgtccttccgccggtccatcgtcgcgccgcgcgacccgccgccgccgcgctcaccgtccaccgacgcgctgatcgaccgcctgttcgcccctctcggctccgcgcctccgccaccggacgacgccgcggcggccgccgtcaaccgcatctaccgcgtcgccgccgccgacgccgcctccctgcaggactcggcggggcccgggcgcacgaagctggaggcgttcacggcccacctgtggcagctcaacgccagggcggcggcggcggagcgtgagcggccgtgctgcatgggcgtcgtcgtcgacgggcgcggccggatgttcccggacggcgccatgagggcctacttcggcaacgtgctgaccataccgtacggcgtgatgggctccggcgagctgcgcgccgcggcgctcgccgacgtggccggcgacgtgcaccggtgggtggcggaggcggccaccggcgaccacttccgcgggctcgtcgactgggtggaggcgcggcgccccaagccggcggcggcgagggcgtacctgggcggcaccggcggcggcgacgcggcggcgtgcatcgtgtcgtccgggatggggttccccgtcggcgaggccgacttcgggacgggcgcgccggcgttcgcgtcgtaccacttcccgtggcccgccggcgccgggtacgtgatgccgatgcccagcgcgcgcggcgacggcgactgggtggtgtacgtgcacgtgtcgccggagttggcggtggcgatggatgaggagcccaccgtgttcaggtcgctggacaacagctacgtgttcggttga

SEQ ID NO: 207 - protein, 282 aa, Arabidopsis thaliana
MVSFCGRRFAFLIIFLFAAQYERVYAGSFHKDVQIHWGDGRGKILDNVGNLLSLSLDKFSGSGFQSHQEFLYGKVEVQMKLVPGNSAGTVTTFYLKSPGTTWDEIDFEFLGNISGHPYTLHTNVYTKGTGDKEQQFHLWFDPTVDFHTYCIIWNPQRVIFTIDGIPIREFKNSEALGVPFPKHQPMRLYASLWEAEHWATRGGLEKTDWSKAPFTAFYRNYNVDACVWSNGKSSCSANSSWFTQVLDFKGKNRVKWAQRKYMVYNYCTDKKRFPQGAPPECS

SEQ ID NO: 208 - DNA, 1059 bp, Arabidopsis thaliana
actactctttccaaaagcaattttaaatggtgtcattttgcggtagaaggttcgccttcttgattatctttctctttgcagcacaatatgagcgtgtctacgctggtagctttcacaaggacgttcagatacattggggtgatggccgtggaaaaattctcgacaatgtcggaaatcttctttctctctcgctcgacaaattctctggttccggttttcagtcccatcaagagtttctttatggcaaagtagaggttcaaatgaaacttgtacctggtaactctgctggaacagtgacaacattctatctaaaatctcctggaactacatgggatgaaatagattttgagttcttgggaaacataagtggtcatccatatactcttcatactaatgtttacacaaaaggcacaggagacaaagaacaacagtttcatctatggtttgacccaactgttgactttcacacttattgtatcatatggaatccccaaagggtcatttttacaatagatggaattccgataagagaattcaagaactccgaagcccttggagttcccttcccaaagcatcaaccaatgaggctctatgctagcctttgggaagccgagcattgggctacaagaggaggattagagaaaacagactggtccaaagctcctttcaccgctttctacagaaactacaatgtggatgcatgtgtgtggtccaatggaaaatcatcatgctctgcgaattcctcatggtttactcaagtacttgatttcaaaggcaagaatagagtgaaatgggcacagagaaagtacatggtctacaactattgcactgataagaaaagatttcctcaaggtgctcctccagagtgcagttaaataactgattgcttgattcacgaattaatcacgtggcattgtctttgtaacggaaatgatgtttatctatattttggcactagctgagtatttgcgctaaataaattacttctctattagtaattgtttttttttgttctattatgttgtttcttttatattatttgtaagtgtgatttgcgtt

SEQ ID NO: 209 - protein, 282 aa, Medicago truncatula
MAYSIGINSMLIGVMIISSLVATCSANFNQDFDLTWGDHRAKIFNGGQLLSLSLDKTSGSGFQSKKEYLFGRIDMQLKLVAGNSAGTVTAYYLSSQGPTHDEIDFEFLGNVSGDPYILHTNVFSQGKGNREQQFYLWFDPTKNFHTYSIIWKPQHIIFLVDNTPIRIFKNAESIGIPFPKNQPMRIYSSLWNADDWATRGGLVKTDWSKAPFTAYYRNFKATELSSVSSTSFSDSALQSNELDAYGRRRLRWVQKYFMIYNYCNDLKRFPEGIPAECKRPRF

SEQ ID NO: 210 - DNA, 849 bp, Medicago truncatula
atggcttattctattggcattaacagtatgctgattggagtcatgataattagctccttggtagctacatgttctgctaacttcaaccaagactttgatctaacttggggtgaccaccgtgctaagatattcaatggtggtcaacttctatctctttctcttgataaaacttctggctctggcttccaatccaagaaagagtatttatttggtagaattgatatgcaacttaaacttgttgctggaaattctgctggaactgttactgcttactatttgtcatcacagggaccgactcatgatgaaattgattttgagttcttaggaaatgttagtggcgatccttacattctccacacaaacgtgttttctcaaggcaaaggaaacagagaacaacaattctacctctggttcgacccaaccaagaacttccacacttactctatcatctggaagccacaacacattatatttttggttgacaacaccccaataaggatcttcaagaatgctgaatcaattggtattccattcccaaagaaccaaccaatgagaatctattcaagtctctggaatgctgatgattgggctacaagaggtggtttggtgaaaactgattggtccaaagcaccctttacagcttactaccgcaatttcaaagctactgagttatcttctgtctcttccacttccttctctgattctgcattgcaaagcaatgagcttgatgcttatggtagaagaagattgagatgggttcagaaatactttatgatctataattactgcaacgatcttaagcgattcccagaaggtattcctgctgagtgtaagcgtccaaggttctga

SEQ ID NO: 211 - protein, 290 aa, Oryza sativa
MAKHLALSVAAAVAVSWLAASSAAAAGFYEKFDVVGAGDHVRVVSDDGKTQQVALTLDRSSGSGFTSKDTYLFGEFSVQMKLVGGNSAGTVTSFYLSSGEGDGHDEIDIEFMGNLSGNPYVMNTNVWANGDGKKEHQFYLWFDPTADFHTYKIIWNPQNIIFQVDDVPVRTFKKYDDLAYPQSKPMRLHATLWDGSYWATRHGDVKIDWSGAPFVVSYRGYSTNACVNNNPAGGWSSSWCPEGTSAWIHRELDGAELGTVAWAERNYMSYNYCADGWRFPQGFPAECYRK

SEQ ID NO: 212 - DNA, 1419 bp, Oryza sativa
ccacaagccttcgtccccacccgacagcgacgtcaccaaaccgcgccaccaccaccaccacccgccgccggagcagcgcctcctcctcctcctcgcgccagtataaatccggcctccccctcgccgtgccactcactcatccaccacccaaagacaaagcaagcaagtacagtagccatggcgaagcatctcgcgctgtccgtggccgccgcggtggccgtgtcgtggctggcggcgtcgtcggcggcggcggcggggttctacgagaagttcgacgtggtgggcgccggcgaccacgtgagggtggtgagcgacgacgggaagacgcagcaggtggcgctgacgctggaccggagctccgggtccgggttcacctccaaggacacctacctgttcggcgagttcagcgtccagatgaagctcgtcggcggcaactccgccggcaccgtcacctccttctacctctcctccggcgagggcgacggccacgacgagatcgacatcgagttcatgggcaacctcagcggcaacccctacgtcatgaacaccaacgtctgggctaatggcgacggcaagaaggagcaccagttctacctctggttcgaccccaccgccgacttccacacctacaagatcatctggaatccccaaaacatcatattccaggtggacgacgtgccggtgaggacgttcaagaagtacgacgacctggcgtacccgcagagcaagccgatgaggctgcacgcgacgctgtgggacggcagctactgggcgacgaggcacggcgacgtcaagatcgactggagcggcgcgccgttcgtggtgtcgtaccgcgggtacagcaccaacgcgtgcgtcaacaacaatcccgccggcgggtggtcgtcgtcgtggtgccccgagggcacgtcggcgtggatccaccgcgagctcgacggcgccgagctcggcaccgtcgcgtgggccgagcgcaactacatgtcctacaactactgcgccgacggctggcgcttcccccagggcttccccgccgagtgctaccgcaagtgattttgaactcgatcgattcaaatcctcctccattgatgagttcttggcaatgatttgtaattgcttcttgttcttgttttcgtcttcgtcttcgtcttcttcttcttgatccatgtacattttgccatccattcgttctccatttgttacagttacagagacaggttgatggtgaattactattgccgccaatttttttcttcttcttgttactcgatccaattattactactagagttcatcttgcacagttgggcggtgtgaaaaactgaaaaagaaaagggtgtcaaatttgttgctgatgctgagcaagtgagcacatgcttatgctctcaggtatgaacaaaataaacagtaaaattatctgca

SEQ ID NO: 213 - protein, 264 aa, Populus trichocarpa
MAAGNFNQQFDTTWGDGRAKVLQNGQLLTLSLDKTSGSGFKSKNQYLFGKIDMQLKLVPGNSAGTVTAYYLSSLGSAHDEIDFEFLGNLSGDPYILHTNVFTQGKGNREQQFYLWFDPTKDFHTYSVLWNPLSIIFSVDGTPIREFKNMESKGIPYPKSQPMWIYSSLWNADDWATRGGLIKTDWSQAPFTASYRNFNAQACTWTSGSSSCSSSGSSSNSWLSQSLGSTGQGRIKWVQKNYMIYNYCTDTKRFPQGPPPECSVA

SEQ ID NO: 214 - protein, 795 aa, Populus trichocarpa
ATGGCTGCTGGTAACTTCAACCAGCAATTTGACACTACATGGGGTGATGGCCGTGCTAAAGTCCTTCAAAATGGCCAACTTCTTACACTCTCTCTTGACAAAACCTCTGGTTCAGGGTTTAAGTCCAAGAACCAATACTTGTTTGGGAAAATCGACATGCAACTAAAGTTGGTACCTGGAAACTCTGCCGGAACTGTCACCGCTTACTATCTATCTTCTTTGGGATCAGCGCATGATGAAATAGATTTTGAGTTCCTTGGTAACCTTAGTGGAGACCCTTATATTCTTCACACCAACGTCTTCACTCAAGGAAAAGGAAACAGAGAGCAGCAATTCTATCTTTGGTTCGACCCCACCAAAGATTTCCACACCTATTCCGTTCTTTGGAATCCTCTTAGCATCATCTTTTCTGTGGATGGGACACCAATTAGAGAGTTCAAGAACATGGAATCAAAGGGCATCCCATACCCAAAGAGCCAACCAATGTGGATATACTCAAGCCTCTGGAATGCAGATGACTGGGCTACAAGAGGAGGTCTTATCAAAACCGATTGGAGCCAAGCACCGTTTACAGCTTCTTACAGGAACTTTAATGCTCAAGCATGCACTTGGACCTCTGGCTCCTCCTCTTGCTCCTCCTCTGGCTCCTCCAGTAACTCTTGGCTATCACAGTCACTGGGTAGCACAGGCCAAGGAAGAATAAAATGGGTGCAAAAGAACTACATGATTTATAACTATTGCACTGACACCAAGCGATTCCCACAAGGACCGCCTCCGGAATGCTCAGTGGCATGA

SEQ ID NO: 215 - protein, 277 aa, Sorghum bicolor
MAPRSLGVLAVALALLQAASAKSWLGAKFTTDGTVREGYDSSGQQVVMLSLDQHSGAAGFNSKEQYLYGEFSIEMKLIRGNSAGTVSCFYLSSGDGDGHDEIDMEFMGNATGQPVVLNTNVWANGDGKKEHQFDLWFDPAADYHTYTIIWNPTNILFKVDNLFIRSFKRYADLAYPSSKPMTLHATLWDGSYWATEKGKMPIDWSGAPFVVSYRSYAANACVSGGACRTGRDGWMHRQLDNAEWGTVRWAEKNFMRYNYCQDGWRFPQGLPAECSRH

SEQ ID NO: 216 - DNA, 1166 bp, Sorghum bicolor
tactggaaaaaaacaaaccaaagtcccctccactttccaagcctccacaaaccaaagagctcttctatagagcagcagccacaccatggcaccgcgttctctgggagtgctcgccgtcgccctcgcgctcttgcaggccgcctcggcgaagtcctggcttggcgccaagttcaccacggacggcaccgtccgcgagggatacgacagttccggccagcaggtggtgatgctcagcctcgaccagcactccggcgccgccggcttcaactccaaggagcagtacctctacggcgagttcagcatcgagatgaagctcatccgcgggaactccgccggcaccgtctcatgcttctacctttcttccggcgacggcgacgggcacgacgagatcgacatggagttcatgggcaacgccaccggtcagccggtggtgctcaacaccaacgtgtgggccaacggcgacggcaagaaggagcaccagttcgacctgtggttcgacccggccgccgactaccacacctacaccatcatctggaaccctacgaacatcctgttcaaggtggacaacctcttcatccggtccttcaagcgctacgccgacctggcctacccgagctccaagcccatgacgctgcacgccacgctgtgggacggcagctactgggcgacggagaagggcaagatgcccatcgactggtccggcgcgcccttcgtcgtctcctaccgcagctacgccgccaacgcctgcgtcagcggcggcgcgtgccgtaccggcagggacgggtggatgcacaggcagctcgacaacgccgagtggggcaccgtcaggtgggcggagaagaacttcatgcgctacaactactgccaggatgggtggaggttcccgcaaggactccccgccgagtgcagccgccactgatgctgatgaactgatacgttctcccccggttcatccagctatactgcgcattgttcattgtttattgcattggtttcgttttcttgggtatatgattcttattctactttgtgaatttgtgattaaaaagcagccctgcagaaacgtgtgggcggttgtacacacctagtttttccctgaacagcagagcatgtaatttttatcgtgcttttggatatatatacaggcatgcagcatgtattgtggg

SEQ ID NO: 217 - protein, 280 aa, Sorghum bicolor
MARRSLALLLASSLALVMMAAVASADSWLYEKFSTDGTVRTNYDESGAQVAMLNLDRSSGAGFNSKEQYLYGQFSVQMKLIPGNSAGTVSCFYLSSGDGDGHDEIDMEFMGNATGQPVVLNTNVWANGDGKKEHQFDLWFDPAADYHTYTIIWNPTNILFKVDDNVIRVFKRYADLAYPSSKPMTLHATLWDGSYWATEKGKVPIDWSGAPFVVSYKGYSADACVSGGACAAGSGAWMNKQPDSAEWGTVKWAESNYMRYNYCDDGWRFPQGLPAECSRS

SEQ ID NO: 218 - DNA, 1304 bp, Sorghum bicolor
ccggggcagcaggggcgcagcaaaccacgcaccagagggccggccaccagtataaagccggcaccacctgtccgtgcatcgccgcacagcagagcagcacaccaccacccaactccactgaacaacacgaccattcttcattttccaggaagctctagagcgcaggtgcagagtgctgtgcagacaccatggcgcggcggtctctggcccttctgctcgcgtcgtcgctggccctcgtgatgatggcggccgtcgcgtcggcggactcgtggctctacgagaagttcagcacggacggcaccgtccgcaccaactacgacgagtccggcgcgcaggtggcgatgctcaacctcgaccgcagctccggcgccggcttcaactccaaggagcagtacctctacggccagttcagcgtccagatgaagctcatccccggcaactccgccggcaccgtctcctgcttctacctttcttctggcgacggcgacgggcatgacgagatcgacatggagttcatgggcaacgccacggggcagccggtggtgctcaacacaaacgtgtgggccaacggcgacggcaagaaggagcaccagttcgacctgtggttcgacccggccgccgactaccacacctacaccatcatctggaacccgaccaacatcctcttcaaggtggacgacaacgtgatccgcgtcttcaagcgctacgccgacctggcctacccgagctccaagcccatgacgctgcacgccacgctgtgggacggcagctactgggccaccgagaagggcaaggtgcccatcgactggtccggcgcgcccttcgtcgtctcctacaaaggctactccgccgacgcctgcgtcagcggcggcgcctgcgccgccggcagcggcgcgtggatgaacaagcagcctgacagcgccgagtggggcaccgtcaagtgggccgagagcaactacatgcgctacaactactgcgacgacggctggaggttcccgcaggggctgccggcggagtgcagccgcagctgattcaattcgatcgttcgccggcgtctcccatcctttcagactcagttcaggcgtccattattgccaaagttcttgatttatttttgctggatatatatatatatctatgattcttgttctgttgttgtgaatttttgtcattgaaaagcagccccgcagcaacgcgagggcgggaatatattactgtagttttgcttgtgtaaagaaaagaagctttgtttctactttttggataaaggaataaaatacttgtgacatgcatatataaacatg

SEQ ID NO: 219 - protein, 358 aa, Arabidopsis thaliana
MEAKGAAQWSSILVPSVQEMVKEKTITTVPPRYVRSDQDKTEVDDDFDVKIEIPIIDMKRLCSSTTMDSEVEKLDFACKEWGFFQLVNHGIDSSFLDKVKSEIQDFFNLPMEEKKKFWQRPDEIEGFGQAFVVSEDQKLDWADLFFHTVQPVELRKPHLFPKLPLPFRDTLEMYSSEVQSVAKILIAKMARALEIKPEELEKLFDDVDSVQSMRMNYYPPCPQPDQVIGLTPHSDSVGLTVLMQVNDVEGLQIKKDGKWVPVKPLPNAFIVNIGDVLEIITNGTYRSIEHRGVVNSEKERLSIATFHNVGMYKEVGPAKSLVERQKVARFKRLTMKEYNDGLFSRTLDGKAYLDALRI

SEQ ID NO: 220 - DNA, 1383 bp, Arabidopsis thaliana
ccaaacttttgtttcgtccaggaaagaagccgacatggaagcaaaaggggcagcacagtggagctctatcctagttccatccgttcaagagatggttaaggagaagacgatcacgaccgttcctcctaggtacgtccggtctgatcaagacaaaactgaagtcgatgatgattttgatgtgaaaattgagatcccaatcatcgatatgaagcgtttgtgttcttcaaccaccatggattctgaggttgagaaactcgacttcgcttgcaaagagtggggatttttccagcttgtaaaccatggaatagactcaagtttcttggacaaagtaaagtcagagattcaagatttcttcaaccttcccatggaagaaaagaagaagttctggcagcgaccagatgagatagaaggtttcggacaagcttttgtggtttcagaagatcagaaactagattgggcagacttgttcttccataccgtgcaaccagttgaattacgcaagcctcacttgttccccaagctacctcttccctttagagatacactggagatgtattcttctgaagtgcagagcgtagctaagatcttaatagcgaaaatggcaagagccctagagatcaaaccagaggaactggaaaagttgtttgatgatgttgattcggttcaaagtatgaggatgaattactacccaccatgcccacaaccagatcaggttattggtctaaccccgcattctgattcggtcggactcactgtactgatgcaagtgaatgacgttgaaggtctccaaatcaagaaagatgggaaatgggttcctgttaaacccctcccaaatgctttcattgtcaatattggagacgtcttagagatcataactaatgggacataccgaagcatagagcatcgcggagttgtgaattcagagaaagagaggctctctattgcaacgtttcacaatgtgggaatgtataaagaagttggtcctgcaaaaagcctagttgaaagacaaaaggttgcaagattcaaaaggctgaccatgaaagagtataacgatggtttgttctctcgtactctcgacggaaaagcttatctagatgctttgagaatctaaagagagcaatgccttgtcgcccactactctgtttctctgttttcttgatttatgcaataaaacaatctctataatcttatcttcattgtctctctatttgcttcatttcgttaaagacaaaaatctcctgtagagaatgcttctacgtattgctacaataagacaataagtttgttcttagcaaaaaaaaggacaataagtttgttaaagtttcttgacacgttcgttgttgctcaaagatatacctaataatatgatcacatgattcacat

SEQ ID NO: 221 - protein, 372 aa, Oryza sativa
MIDREPAGSSRHGSNMDPSINIPVNRDAITEEVAAAFAESEVIPERYCRPDEVHDGIVVGHDDDEAYELPVVDMEKLLDPELAEAEIAKLGSACQDWGFFQLVNHGVDEQVVNEMKDSTVKFFSLPLESKRTVEIQDNGFEGFGHHYRRASGKLDWAESVILLTQPIQERNPEMWPTNPSSFRDALDKYSAEMTKLAMRIASIMATDLGVDQEALVGAFRDKQQSMAIHHYPPCRHPDKVIGITPHSDGLGLTLLLQLDDTPGLQIRKDGRWLPVRPRPGTFIINVADILEVLTNGAYKSVEHRVLADAEKGRTTIVTFHEAYVDGMVKPIPEVLKLNGAEARYKSIERIEYIKGNFVALSEGTRFLESLKI

SEQ ID NO: 222 - DNA, 1187 bp, Oryza sativa
gctatgaagtgaagaggccattgttggggccaaaagatctaccgctctgcatcaataagctgcccccgatgatcgatcgtgagcctgcgggtagtagtaggcacggaagtaatatggatccatccatcaacataccggtcaacagagatgccatcaccgaagaagtcgccgccgcgttcgcggaatccgaggtgatccccgagaggtattgccgacctgatgaggtccatgacggcatcgtcgttggccatgacgatgacgaggcctacgagctgccggtggtggacatggagaagctgcttgacccggagcttgcggaggcagagattgcaaagcttggttctgcatgtcaagattggggtttctttcagttagtaaaccatggagtcgacgaacaagtggtgaatgaaatgaaagacagcacggtcaaattcttcagcttgccactagaaagcaaaaggacagtggaaatccaagacaatggctttgaagggtttggccaccattacagaagggcatcaggtaagctggactgggcggagagcgtgatcctccttacgcagccaatccaagagagaaacccggaaatgtggcctacaaacccatcgtcgttcagggatgcacttgacaagtactccgccgagatgacgaagctggctatgaggattgcgagcatcatggctaccgacctcggggtcgaccaggaggctttggttggcgcctttagggataaacagcagagcatggccatacaccactaccctccttgccgccacccagacaaggtgatcggcatcacgccgcactccgatggtctcggcctgacgctgctgctgcagctcgacgacacgcccggcctgcagatcaggaaggatggcaggtggttaccagtgcgacctcgcccgggcaccttcatcatcaatgtcgccgacatactcgaggtccttaccaatggcgcgtacaagagcgtcgagcacagagtactcgcggacgcagagaaaggccgaaccaccatcgtgacatttcatgaagcctatgtcgatggaatggtgaagccgatcccggaggtgctcaagctcaacggagcagaggcacgctacaagtccatagaaagaattgagtatatcaagggaaactttgtggcgctttctgaggggacacgatttctggagagccttaagatatag

SEQ ID NO: 223 - protein, 359 aa, Populus trichocarpa
MASKPSSLGSSLLVPCVQELAKDLLVAVPPRYIRYDQEHPIIASHDPVSEVPVIDMQRLLDQETMDSELGRLHFACKTWGFFQLVNHCVSSSLLDKMKTQLQDFFNLPMEEKKRFWQYPGEIEGFGQAFVVSEEQKLDWGDLFFMVTQPANLRKPHLFPKLPLPFRDTLESYSLEVKNLASAILEQMGKALNIKAEEMRDFTEGIRQSMRMNYYPQCPQPEQVIGLTPHSDATGLTILLQVNEVEGLQLRKDGKWVPIKPLPNAFVVNVGDILEIVTNGAYRSIEHRATVNSKKERLSVASFHSPRFDGKVCPAPSLVTEQTPALFKEVPVKEYFKGLFSRELVGKSYLDTLRIQDGQA

SEQ ID NO: 224 - DNA, 1082 bp, Populus trichocarpa
atggcatccaaaccatcaagtcttggaagctccctgcttgtgccctgtgttcaagaattggccaaggatcttttggtcgctgttccaccaagatacatccgttatgaccaagaacatcccatcattgctagtcatgatccggtatctgaggttccagttattgatatgcagagattacttgatcaagaaacgatggattctgaattgggccgcctccatttcgcttgcaaaacatggggtttcttccagttggtaaaccattgtgtaagctcttcgttgttagacaaaatgaagacacaacttcaggatttcttcaacctcccaatggaggaaaagaaaaggttctggcagtatccaggagaaatagagggttttggacaagcttttgttgtatctgaggagcaaaagcttgattggggcgatctgttcttcatggtcacccagccagctaatttaagaaagcctcacctattcccaaaactccctcttcctttcagagacaccttggagagctactccttggaagtgaaaaatctagcgtctgctattcttgaacagatgggaaaagctttaaacattaaagctgaagaaatgagagatttcacagagggcataagacaatcaatgaggatgaactattatccgcagtgtcctcaaccagagcaagttattggccttacacctcattctgatgccaccggtctcacaattctcctacaagttaatgaagtggaaggtctgcagttaaggaaggatgggaagtgggttcccataaagccactgccaaatgcttttgttgtcaatgttggagacattttggagattgtaaccaatggtgcatatcgtagcatcgagcatcgtgcaacagtaaactctaagaaggaaagactttcagttgcttcattccattccccgaggtttgatggcaaagtatgcccagctcctagcttggtaaccgaacaaacaccagcattgtttaaagaagttccagttaaagagtacttcaagggcctgttttctcgtgagcttgttggaaaatcttatcttgatacattgagaatacaagatggtcaagcctaaaa

SEQ ID NO: 225 - protein, 513 aa, Arabidopsis thaliana; identical to SEQ ID NO: 151

SEQ ID NO: 226 - DNA, 1835 bp, Arabidopsis thaliana; identical to SEQ ID NO: 152

SEQ ID NO: 227 - protein, 511 aa, Medicago truncatula; identical to SEQ ID NO: 179

SEQ ID NO: 228 - DNA, 1536 bp, Medicago truncatula; identical to SEQ ID NO: 180

SEQ ID NO: 229 - protein, 519 aa, Oryza sativa
MAMELAALCTDPVVLSAAFLCLLLHLSLRSYRPPSPGGGRRLPPGPPGLPVLGALPLVGPAPHAGLASLARKYGPVMYLKMGTCGVVVASSPCAARSFLKALDARFANRPAVASAVDITYNYQNMVFANYGARWKLMRKLASVHLLGARALADWAAVRRDEARRLLRGVAEASAAGRPVVIPEVLVCALANIVGQITVSKRVFDVQGDESNSYKDMIVSLLTGAGLFNISDFVPALAWLDLQGVQAKLRRIHDQFDVLITKLLADHAATAADRARAGRTDFVDRLRAAVGVDDEDGETISEVNIKGLIFDMFTAGTDTSSIIVEWAMAEMMKNPAVMARAQEEMDRVVGRGRRLEESDIASLPYLQAVCKEAMRLHPSTPLSLPHFSFDECDVDGYRIPANTRLLINIYAIGRDPSAWEDPLEFRPERFMPGGAAERVDPLGNYFELIPFGAGRRICAGKLAGMVFVQYFLGTLLHSFDWRLPDGEDKVDMSETFGLALPKAVPLRALVTPRLAPAAYA

SEQ ID NO: 230 - DNA, 1996 bp, Oryza sativa
gggggcttgggcagcgcgcgcgcaaaaccgagttcgccgcccacctcgccgccatggccatggagctcgccgcgctctgcaccgaccccgtcgtgctctccgccgccttcctctgcctcctcctccacctctccctccgctcctaccgcccgccctcccccggcggcggccgccgcctccccccgggacccccgggcctccccgtcctcggcgcgctgccactcgtcggcccggccccgcacgccggcctggcgtcgctggcgcgcaagtacgggcccgtcatgtacctcaagatgggcacctgcggcgtggtggtggcgtcgtcgccgtgcgcggcgaggtcgttcctgaaggcgctcgacgcccggttcgcgaaccggccggcggtggcgagcgccgtggacatcacgtacaactaccagaacatggtgttcgccaactacggcgccaggtggaagctgatgcggaagctggcgagcgtccacctgctcggcgcccgcgcgctcgccgactgggcggcggtgcgccgcgacgaggcccgccggctgctgcgcggcgtggcggaggcgtccgccgccggccgccccgtcgtcatcccggaggtgctcgtctgcgcgctcgccaacatcgtcggccagatcaccgtcagcaagcgggtgttcgacgtgcagggcgacgagtccaacagctataaggatatgatcgtctcgctgttgacgggtgcggggctgttcaacatcagcgacttcgtgccggcgctggcgtggctggacctgcagggagtccaggccaagttgcggcggatccacgaccagttcgacgtcctcatcaccaagctgctcgccgaccacgccgccaccgccgccgaccgcgcccgcgccggccgcaccgacttcgtcgacaggctccgcgccgccgtcggcgtcgacgacgaggacggcgagaccatctccgaggtcaacatcaagggcctcatcttcgacatgttcacggccgggacggacacgtcgtcgatcatcgtggagtgggcgatggcggagatgatgaagaacccggcggtgatggcgcgggcgcaggaggagatggaccgcgtcgtcggccgcggccgccgcctggaggagtccgacatcgccagcctcccctacctccaggccgtctgcaaggaggccatgcggctccacccctccacgccgctcagcctcccgcacttctccttcgacgagtgcgacgtcgacggctaccgcatcccggcgaacacgcggctgctcatcaacatctacgccatcggccgcgacccgtcggcgtgggaggacccgctggagttcaggccggagcggttcatgccggggggcgccgccgagcgcgtggacccgctcggcaactacttcgagctcatccccttcggcgccggcaggaggatctgcgccgggaagctcgccggcatggtgttcgtccagtacttcctcggcacgctgctgcactcgttcgactggcggctccccgacggcgaggacaaggtggacatgtcggagacgttcggcctcgcgctgcccaaggccgtcccgctccgcgccctcgtcacgccgcgcctcgcgccggccgcctacgcgtgacggccggccggcgacgacgaggacgacgccgtgtatgtgatcgatcgagttcgccgcggcggcggcggcggcggcgatctgatgttgcggttgtctgtacgtaaatatatttttcgtttgttggtttcgaaagcaaaacacaattaagaacgcccaaatattgcaagcaaatacgcctgtgaattgatttcttctatgatctgtttcatcgatcctagctaacgtgttttatcgaggcaagttaattagaacgaattgacggattgtaattgttggggttaacttaggacaacgtacgttgataatggtaggaggacaaatgtcatccaactttgaaaaatgaaaatcgagtttcaagaaataaagtttattgagtaaatttc

SEQ ID NO: 231 - protein, 508 aa, Populus trichocarpa
MDVDPVLPGKLTLAALLFFISYQFTGSFIRKLLHRYPPGPRGWPIIGAIPLLGDMPHVTLAKMAKKHGPVMYLKMGTRDMVVASNPDAARAFLKTLDLNFSNRPIDGGPTHLAYNAQDMVFADYGPRWKLLRKLSNLHMLGGKALEDWAPVRVTELGHMLRAMCEASRKGDPVVVPEMLTYAMANMIGQIILSRRVFVTKGSESNEFKDMVVELMTSGGFFNIGDFIPSVAWMDLQGIERGMKKLHRRFDVLLTKMIEDHSATSHERKGKPDFLDVLMANQENSDGARLCLTNIKALLLDLFTAGTDTSSSVIEWALAEMLKNQSILKRAQEEMDQVIGRNRRLVESDIPKLPYLQAVCKETFRKHPSTPLNLPRIADQACEVNGYYIPKGARLSVNIWAIGRDPDVWDNPEVFTPERFFTEKYAKINPRGNDFELIPFGAGRRICAGARMGIVLVEYILGTLVHSFDWKLPEDVDLNMDEVFGLALQKAVPLSAMVSPRLEPNAYLA

SEQ ID NO: 232 - DNA, 1527 bp, Populus trichocarpa
atggacgtagacccagtcctccctgggaaacttaccttggcagctctcttattctttatcagctaccaatttactggctctttcatcagaaaattgttgcatcgataccccccgggacctcgaggttggccgatcattggtgcaattcccctcctaggagacatgcctcatgtcacattagccaaaatggccaagaagcatggtcccgtcatgtacctgaaaatgggtactcgtgacatggttgtggcctccaacccagatgcagcccgagccttcctcaaaacccttgacctaaatttctcaaaccgtcccatagatggaggtccaactcacttagcttataatgcacaagacatggtcttcgcagattacggaccaaggtggaaattgttgcgcaaattaagtaacctgcacatgctaggtggtaaagctctagaggattgggctcctgtccgagtaaccgagctaggtcacatgctccgagccatgtgcgaggctagccgaaaaggagatcctgtggtggtgccagaaatgttgacctatgcaatggcaaatatgataggacaaattatacttagtcgtcgtgtgtttgttacaaagggctcagagtctaatgagttcaaggatatggtggtggagctaatgacaagcggggggtttttcaatattggagattttataccgtctgttgcttggatggatttgcaaggaattgaacgtgggatgaagaaattacatagaaggtttgatgtgttactgacgaaaatgattgaggatcattcggcaaccagtcatgaacgcaagggaaagccggattttcttgacgttctaatggccaaccaagaaaattcggatggtgcgaggctttgtcttaccaacattaaggctcttctcttggacttattcacagctggtaccgacacctcctcgagcgtaattgaatgggcacttgccgagatgttgaaaaaccagagcatccttaaaagggctcaagaagagatggatcaagtcatcggtcggaatcgacggctagttgaatctgacataccaaaacttccatacctgcaagccgtatgcaaagaaacatttcgaaaacacccatcaacgcctctaaacctccccaggattgcagaccaagcatgtgaagtgaatggatattatatccctaaaggcgctagactcagtgttaacatttgggctatagggagggacccagatgtgtgggataatccagaggtctttactcctgagagattctttactgaaaaatatgcaaaaattaatccacggggaaatgattttgagctaattccgtttggagcagggagaagaatttgtgctggggctagaatgggaattgtgctggtggagtacattttaggcacgttggtgcactcttttgattggaaattgccggaggatgttgatctcaacatggacgaggtcttcggccttgcattgcagaaggctgtccctctctccgctatggttagcccacgcctagaacctaatgcatatcttgcctaa

SEQ ID NO: 233 - protein, 505 aa, Populus trichocarpa
MVLLWELTMAALFFFINYLLTRCLIRKLSTRQLPPGPRGWPIIGAIPVLGAMPHAALAKMAKQYGPVMYLKMGTCNMVVASTPDAARAFLKTLDLNFSNRPPNAGATHLAYNAQDMVFADYGPRWKLLRKLSNLHMLGGKALEDWAHVRVSELGHMLRAMCEASRKGEPVVVPEMLTYAMANMIGQIILSRRVFVTKGSESNEFKDMVVELMTSAGLFNVGDYIPSVAWMDLQGIERGMKRLHRRFDVLLTKMMEEHIATAHERKGKPDFLDVLMANQENLDGEKLSFTNIKALLLNLFTAGTDTSSSIIEWSLAEMLKNPRILKQAQDEMDQVIGRNRRLEESDIPKLPYLQAICKETFRKHPSTPLNLPRIADQACEVNGYYIPKGTRLSVNIWAIGRDPDVWDNPLDFTPERFFSEKYAKINPQGNDFELIPFGAGRRICAGTRMGIVLVQYILGTLVHSFDWKLPKDVELNMDEVFGLALQKAVPLSAMVTPRLEPNAYLA

SEQ ID NO: 234 - DNA, 1518 bp, Populus trichocarpa
atggtccttctctgggaactcaccatggcggctctcttcttctttattaactaccttcttactcgctgtttgataagaaaactgtccacccgtcaactgcctccaggcccccgagggtggccgatcattggtgctattcccgtcctaggagccatgccccatgccgccttagccaaaatggccaaacaatacggccccgtcatgtacttaaaaatgggcacttgtaacatggttgtggcctccaccccagacgcagctcgagccttcctcaaaacccttgatctaaatttctcaaaccgtcccccaaatgcaggtgcaactcatttagcctataatgcacaagacatggtctttgcagattatggaccaaggtggaaattgttgcgcaaattaagcaacctacacatgctaggtggtaaggctctagaggattgggctcatgtccgagtatccgagctagggcacatgcttcgagccatgtgcgaggctagccgaaaaggcgaacctgtggtggtgccagaaatgttgacctatgccatggcaaatatgataggccaaattatacttagtcgtcgtgtgtttgttactaaaggttcagagtctaatgagttcaaggacatggtagtggagctcatgacaagcgcaggattattcaatgttggcgattatataccgtcggttgcttggatggatttgcaaggaattgaacgtgggatgaagagattacatcgaaggtttgatgtgttactgacaaaaatgatggaggagcatattgcaacggctcatgaacgcaagggaaagccggattttctggacgttctcatggctaaccaagaaaatttggatggtgagaagcttagctttaccaacatcaaggctcttcttttgaacttattcacagccggcactgacacttcctcgagcataatcgaatggtcacttgctgagatgttgaaaaaccctcgcatccttaaacaagctcaggatgagatggatcaagtcattggtcgaaatcggcgactagaggaatctgacataccaaaacttccctacctgcaagccatatgcaaagaaacattccgaaaacacccatctacacctctaaacctacccaggatagctgaccaagcatgtgaagtgaatggatactatatccccaaaggcactagactgagtgtcaacatctgggcaatagggagggatcctgatgtatgggacaatccactagactttactcctgagagattttttagtgagaaatatgcgaaaatcaaccctcaaggaaatgattttgagctaattccatttggagctggaagaagaatttgtgctgggactagaatggggattgtgctagtacagtacattttaggcacattggtacactcttttgattggaaattgccaaaagatgttgagctcaacatggatgaggtctttggtcttgcattgcagaaggcagttcccctttccgccatggttactccacgcctggaacctaacgcatatcttgcttaa

SEQ ID NO: 235 - protein, 139 aa, Sorghum bicolor
MRLHPLTPLSLPHFSFDACDDVGGGYRVPANTRLLINVWAIGRDPATWEAPLEFRPERFLPGAAAEKVDPMGNYFELIPFGAGRRICAGKLAGMVFVQYFLGTLLHAFNWRLADGEELDMRETFGLTLPKAVPLRAIVT

SEQ ID NO: 236 - DNA, 681 bp, Sorghum bicolor
  misc_feature 105, 110: n = A,T,C or G
gaaatgctcaagaacccgcccgtcatggcacgagcgcaggaggagctggaccgcacggtcggccgcggccgccgcctggaagagtcggacctgcccagcctcccntaccntgcaggccgtctgcaaggaggccatgcggctgcacccgttgacgccgctcagcctcccgcacttctccttcgacgcctgcgacgacgtcggcggcggctaccgcgtcccggccaacacccggctgctcatcaacgtctgggccatcggccgggacccggcgacgtgggaggcgcccctcgagttccggccagagcggttcctgccgggggccgcggcggagaaggtcgacccgatggggaactacttcgagctcatccccttcggcgccggccggaggatctgcgccgggaagctggccggcatggtgttcgtgcagtacttcctgggcacgctgctgcacgcgttcaactggcgcctcgccgacggcgaggagctggacatgcgcgagacgttcgggctcacgctgcctaaggccgtaccgctccgcgccattgtcacgccgcggctcctgccggaagcctatgcttgagttagttgtcacttgtcagtctcagtccgcgctgtggaaggatgatcggaaaggtttgtgcttgccaaccctgcatacatattctgtttatatgttttttt

SEQ ID NO: 237 - protein, 246 aa, Arabidopsis thaliana
MATSRTFIFSNLFIFFLVIATTYGQAPAPGPSGPTNITAILEKAGQFTLFIRLLKSTQASDQINTQLNSSSSNGLTVFAPTDNAFNSLKSGTLNSLSDQQKVQLVQFHVLPTLITMPQFQTVSNPLRTQAGDGQNGKFPLNITSSGNQVNITTGVVSATVANSVYSDKQLAVYQVDQVLLPLAMFGSSVAPAPAPEKGGSVSKGSASGGDDGGDSTDSSDAERTGFGFGIRITTVAAIAASSSLWI

SEQ ID NO: 238 - DNA, 882 bp, Arabidopsis thaliana
acacacaacaactacaacaatggctacttcaagaacattcattttctctaatctcttcatcttcttcctcgttatagccactacttatggtcaggctccagctccaggcccttcaggtccaacgaacataaccgcaatcctagaaaaggctggtcaattcacattgttcataagacttcttaaaagcactcaagcctcagaccaaatcaacactcagctcaattcttcctcgagtaatggcttaaccgtgtttgccccgactgataacgccttcaacagcctcaaatccggaaccttaaactcattgtctgaccaacaaaaagttcagcttgttcagttccatgtcttacctacactcataaccatgcctcagtttcaaaccgttagtaaccctttacgcacgcaagctggagatggccaaaacggtaaattccctcttaacatcactagctccggtaaccaagttaacatcaccactggagttgtcagcgccaccgtggctaactctgtctacagcgataagcagctggccgtttatcaggttgatcaagttttgctgccattagccatgtttggatcaagcgtggctcctgctccggcccctgagaaaggcggctctgtttcaaaaggctcagcttccggtggcgatgatggaggagattctactgattcatctgatgcagagaggactggattcgggtttgggatcagaatcactaccgttgcagccattgctgcttcttcttctctgtggatataactcgagagagagcttttcttgagtctccacatttggaattttaagaataacgagagctttaagtttttgttgtactttgagattgttttatagatgtgttattacgtgtgattgttttgatt

SEQ ID NO: 239 - protein, 256 aa, Medicago truncatula
MAKLFNFFPLFFLNVFIIVTLFQRISAQPAISPAPSGPLNITKVLEKAGQFTTFIKLLKATQVSDRINSQLNNSNQGLTIFAPTDNAFSSLKSGTLNSISTQNQLQLLQFHILPTLYTISQFQTASNPLHTQAGNSDDGEYPLNVTTSGNQVNVTTGVIDTTVSNTIYSDNQLAVYQVDQVLLPMALFGQGPTAAPAEAPAPTKPEKSVRASDAPKGSSDSPADDSSAVGLNGYIVNGATLFVAVFANVVVSCLWM

SEQ ID NO: 240 - DNA, 771 bp, Medicago truncatula
atggctaagctattcaatttctttcctctcttttttctcaacgtattcatcattgtgacattgtttcaaagaatttcagctcaaccagctatatcaccagcaccatcaggaccattaaacataaccaaagtcctagaaaaggcaggacaattcacaacattcatcaagctactaaaagcaacacaagtatccgaccgaatcaactcacaactcaacaactcaaatcaaggcctaacaatttttgcaccaacagataatgccttctcgagtctaaaatcaggaacactaaactcaatcagcacacaaaaccaacttcaacttctacagtttcatattctaccaacactttacacaatatcacagtttcaaactgcaagtaaccctctacacacacaagctggaaacagtgatgatggagagtatcctcttaatgttactacttctggaaatcaagttaatgtaacaactggtgtgattgatacaactgtttctaatactatttatagtgataatcagcttgcagtgtatcaggttgatcaagtgcttcttcctatggcactttttggacaaggtccaaccgctgcgcctgcggaggctcctgcaccgactaagccggagaaaagtgttcgggcttctgatgctccaaaagggtcttcggatagtccggctgatgattcgagtgctgttggtttgaatggctacatagttaatggtgctacattgtttgttgctgtttttgccaatgttgttgtttcttgtttgtggatgtaa

SEQ ID NO: 241 - protein, 269 aa, Oryza sativa
MQAMQRLVLCLVVSMAIAASAQGPTAAPAAPAPATPAAPATPAAPAPASTKTTNITGVLAKAGQFNTLIRLMRSTGAAEQIDNQLNSSRNGLTVFAPTDNAFTSLPSGTLNSLSDQQKNSLVQYHVLSTLIPMSQFDTVSNPLRTQAGSNSPGQYPLNVTAEGQQVNISTGVVNATVGNALYTGDNLVVYQVDKVLLPMAIYSTPAPAPAPLSPATKKKGKTPATSVADAPEAADATPDATTPSLAAARVTAGAGVGVVLALASVWLGL

SEQ ID NO: 242 - DNA, 1165 bp, Oryza sativa
attacgatcgatcttgaattcttgatcagttgagttgcattgcatgcagaaagctcatcacaagttcacaaccaatagcaatcaccaagttttttttttgacactgtgacagcatccaccatgcaagccatgcagagacttgtgctgtgtcttgttgtgtccatggccatcgcggcgtcggctcagggcccgacggcggcgccggccgcgccggcgccggcgacaccggcggcaccggcgacgccagcggcgcccgcgccggcgtcgacgaagacgacgaacatcacgggggtgctcgccaaggccgggcagttcaacacgctcatcaggctgatgcggtccaccggcgcggcggagcagatcgacaaccagctgaacagctcgcgcaacgggctgacggtgttcgcgccgacggacaacgcgttcacgtcgctcccctccggcacgctcaactcgctgtccgaccagcagaagaactcgctggtgcagtaccacgtgctgtccacgctgatccccatgtcgcagttcgacaccgtcagcaacccgctccggacgcaggccggcagcaactcgccggggcagtacccgctcaacgtgacggcggaggggcagcaggtgaacatctccaccggcgtcgtcaacgccaccgtcggcaacgcgctctacaccggcgacaacctcgtcgtgtaccaggtggacaaggtgctgctcccgatggccatctacagcacgccggcgcccgcgcccgcgccgctgtcgccggcgacgaagaagaaggggaagacgccggccacgtcggtcgccgacgcgcccgaggccgccgacgcgacgccggacgcgacgaccccgtctctcgcggcggcgagggtgacggccggtgctggtgtcggggtggttcttgccttggcgagcgtctggttggggctgtgacgatgaggttgatgacaagtttgagcgagatctctgtattgtacgcgccttccataattttttctgttgttttttttctctcttaattttttttgttgttgaaaaggtgttcttttcttaatgttctgtccatttttggttgaattattgctcgtcatatcattaccattattattgtaattgctaggagtatgtaatgtatcattggattcccatttttctgtaatgtaatggt

SEQ ID NO: 243 - protein, 239 aa, Populus trichocarpa
MRKQLLSPFVPFLMFFLYSSTTFAQTPSPAPSGPTNITAILAKAGQFTTLIRLLKSTQEADQINTQLNNSNQGLTVFAPTDNSFANLKAGTLNSLSDQQKVQLVQFHILPNFLSMSNFQTVSNPLRTQAGNSADGEFPLNVTTSGNQVNITTGVNTATVANTIYTDGQLVVYQVDQVLLPLDLFGTAPAPAPAPSKPEKDVPAKAPAGSKEDASVDSSGASIATVSFGVVLIAAISLKL

SEQ ID NO: 244 - DNA, 1099 bp, Populus trichocarpa
accttcaaatttgtagcctttcacctaacaataacaaccactaaacatttctccccccacaatatatacatcccacgcctctccctacagctcaaactcttcctcatcacaattagcaaacagtaagtttgaacacactcaagatttgaaatatcctacaacgatgagaaagcaacttctctccccattcgttcctttcttgatgttcttcctctacagctccaccacttttgctcaaaccccatctccagcaccttcaggtccaaccaacataacggcgatccttgcgaaagctggtcagttcacaaccttaattcggttgttgaaaagcacccaagaggctgaccaaatcaacacacaactcaacaattcaaaccaaggcctaacagtctttgcaccaactgataattcctttgctaacctcaaagcaggtacactgaattcgctcagcgaccaacaaaaggtccaattggtgcaatttcacatccttccaaatttcctttccatgtcaaacttccaaactgtcagcaatcccttgcgcactcaagccggaaatagtgctgatggcgagttcccgctcaatgtgacaacatcggggaatcaagtgaacataacaacaggggttaatactgcaaccgtggcaaacactatatacaccgatggccagttagttgtgtatcaggtggatcaggtccttctgccgttggatctttttggtacagcaccagcaccagctcctgcaccttcaaagcccgagaaagatgttccagcaaaagctcctgcagggtccaaggaagatgcatctgttgatagttcaggtgcatccattgcaacagtatccttcggtgttgtgctgatcgcagcaatttcattgaagctatgagtttttgtttttggacattgttgaggagttattgttttatcgttctgttgtggtttgaactgagttggattattctttggttactctgcctctcctcttaatgtaatgtaccatgattgactgagttcttcttcctccccgctcatttttgtgattcttatgttcaaatatcattctaaattgcaaataagatttcttttacaggtgaattgataa

SEQ ID NO: 245 - protein, 267 aa, Sorghum bicolor
MQRLARVLVVLVVAAATASAQGPTAAPATPTPATPAAPAPKAATTTTTSSNITGVLAKGGQFNTFIRLLKSTGVASQIDNQVSNGGNGITVFAPTDNAFTSLPAGTLNSLSDQDKNALVQYHVVSTAIPMSQFDTVSNPLRTQAGSASPGEYPLNVTSEGQQVNITTGVVNATVANSLYSEDSLVVYQVDKVLLPQKLFGAAEAPAPAPLAPAKKKGKTPAAVADSPEAEAEASPDATTASLAPARLTTGGAGLAAALALAGVWWGL

SEQ ID NO: 246 - DNA, 1108 bp, Sorghum bicolor
catttgcatttccatttccatgcacagacttggcaagtaacacgtcgccgccccatcccatcagcagcagcagcagcagtcaccatgcagagactcgcgcgcgtcctcgtggtgctcgtcgtagccgccgccacggcgtcggcacagggcccgacggcggcgccagcgacgcccacgccggcaacacccgcggcgccggcgcccaaggcagcgacaacgacgacgacgtcgagcaacatcacgggcgtgctggccaagggcgggcagttcaacaccttcatccggctgctcaagtccacgggggtggcgtcgcagatcgacaaccaggtcagcaatggcgggaacgggatcacggtgttcgcgcccacggacaacgccttcacgtcgctccccgccggcacgctcaactcgctgtcggaccaggacaagaacgcgctggtgcagtaccacgtcgtgtccaccgccatccccatgtcgcagttcgacaccgtcagcaacccgctccggacgcaggcagggagcgcctcccccggggagtacccgctcaacgtcacctccgagggacagcaggtgaacatcaccacgggtgtcgtcaacgccaccgtcgccaactcgctctactccgaagacagcctcgtcgtctaccaggtcgacaaggtgctgctgccgcagaagctcttcggcgcggcggaagcgcccgcgcccgcgccgctcgcgccggccaagaagaagggcaagacgccggcggccgtcgcggactcgcccgaggcggaggcggaggcgtccccggacgcgacgaccgcgtcgctcgcgccggcgaggttgacgacgggaggtgccggcctcgccgcggctcttgcgctcgccggcgtgtggtggggactgtagggacggcgatgaggtttacggccgtgacatccatcatgcatgccatctttttgtatactttttttttgcaggtcttgttggtcttttcgtgcccatttttggatgaaattattcttccctgcccttgaaattgctaggagtatgtcttgtaatggttaatgtaatgtcgttgtctcatttttatgtatttccactaaataaatatgagttgcgtatattc

SEQ ID NO: 247 - protein, 366 aa, Arabidopsis thaliana
MKKVKLSLIANERSRKTSFIKRKDGIFKKLHELSTLCGVQACALIYSPFIPVPESWPSREGAKKVASRFLEMPPTARTKKMMDQETYLMERITKAKEQLKNLAAENRELQVRRFMFDCVEGKMSQYHYDAKDLQDLQSCINLYLDQLNGRIESIKENGESLLSSVSPFPTRIGVDEIGDESFSDSPIHATTGVVDTLNATNPHVLTGDMTPFLDADATAVTASSRFFDHIPYENMNMSQNLHEPFQHLVPTNVCDFFQNQNMNQVQYQAPNNLFNQIQREFYNINLNLNLNLNSNQYLNQQQSFMNPMVEQHMNHVGGRESIPFVDGNCYNYHQLPSNQLPAVDHASTSYMPSTTGVYDPYINNNL

SEQ ID NO: 248 - DNA, 1387 bp, Arabidopsis thaliana
atagtttctctcattttataataattttctccatcttcttccttcctcttcaagcttatagaacctccaagaaccataaaactctctctgcaacaatctatactttcttcattacttttataaaaaatgggaagacattcttgttgttttaagcagaagctaagaaaaggcctttggtctcctgaagaagatgagaaacttctcaattacatcactagacatggtcatggctgttggagttctgtccctaaactcgcaggtttgcaaagatgtggaaagagttgtagacttaggtggataaattatttgagaccagatttaaagagaggagctttctctcaagacgaagaaagcttgatcattgagctccatgctgcattaggcaacagatggtctcaaatcgcaacgcggttaccgggaagaacagacaacgagatcaaaaacttttggaactcatgtcttaagaagaagctgagaagaaaaggcattgacccaacaacacataaacccttaataacaaacgagcttcaatctcttaacgtcatagatcagaaactgacgtcatcagaagtagtaaagtcaacgggttcgataaacaacctacatgatcagtcaatggtcgtctcatcgcaacaaggtccatggtggttcccggcgaatacaactacgactaatcaaaactctgcgttttgctttagttcaagtaatactacaacggtttcagaccagatcgtatctttaatctcttcaatgtctacgtcatcatctccgacaccaatgacttcaaacttcagtcctgctccaaacaactgggaacaactcaactactgcaacacagtaccaagtcagagcaacagtatctacagtgccttctttggtaatcaatacacagaagctagccaaaccatgaacaataataatccactagtagatcaacatcatcatcatcaagacatgaagtcatgggcatcagagattcttcattacacagaacacaaccaaagctcagaaactgttatagaagcagaagtgaagccagacattgccaactactactggagatcagcatcatcatcgtcgtcaccaaaccaagaagctgcaacattactacacgatgctaacgtggaagtgtacggtaaaaatctacaaaagcttaataacatggtgtttgatcagagcctttagattattaacatgtgttatagagagtttcattttctattcatattcatagacctgagtttattgattgatccatacatttgttatgcttgtgtgtaaagtatgtatatggtttttgatttatgtaaattttctgctcgagtgaatttttttggtgctaagatgtagttctttattccatttccttacttatgactttgacctg

SEQ ID NO: 249 - protein, 369 aa, Medicago truncatula
MGRHSCCYKQKLRKGLWSPEEDEKLLNYITKHGHGCWSSVPKLAGLQRCGKSCRLRWINYLRPDLKRGAFSQQEENLIIELHAVLGNRWSQIAAQLPGRTDNEIKNLWNSCLKKRLRQSGIDPNTHKPLSEVENDNEKSLTSNKTNQKGSVSSNEVMSLMIEPTKPSIEGYPLEVSTTSKINNSSSSSHELFLDTRFGSSSSYFSFQNLNYGSNIGISENPNASSICFTPTSTSSQIMSDTNSVITSNMLHSVSPSIFSTPTHVKPTVSVSSVDGVHNWEASSYNNINNTNNGALPLQEEMKWSEYLNTPFLMQNQPSPSMYTEAKPETGFITDESCTSWQQQQQQNFQLSDIYSKDLQRFSVAFGQSM

SEQ ID NO: 250 - DNA, 1110 bp, Medicago truncatula
atgggaagacactcttgctgctacaagcagaaattaaggaaaggactttggtctcctgaggaagatgagaagcttttgaattacattaccaaacatggtcatggatgttggagttcagtccccaaactagcaggtttgcaaaggtgtgggaagagttgcaggttaagatggataaattacttgaggcctgatttgaaaagaggagcattctcacaacaagaagagaatttgatcattgaacttcatgctgtacttggtaacagatggtctcagattgcagcacaattaccaggaagaactgacaatgagattaaaaatctatggaattcatgtctcaagaagaggttgagacaaagtggcattgatccaaacacacacaaaccactctctgaggttgaaaatgacaatgaaaaatcactcacatccaacaaaaccaatcaaaaaggttcagtttcatccaatgaagttatgagtttgatgattgaacctacaaaaccttctatagaaggataccctctagaagtttctactacctcaaagatcaacaacagtagtagcagcagccatgaattattcctggataccaggtttggtagcagttcaagttatttttctttccagaacttgaactatggatcaaacatagggatttctgaaaatccaaatgcatcatctatttgtttcacaccaacttcaacttcttcacaaattatgtcagatacaaattctgttataacttccaatatgctccattctgtatcaccctcaattttctcaactccaacacatgttaaaccaactgtttccgtttcctcggtggacggagttcataactgggaagcaagtagctacaacaacattaacaacacaaacaacggcgctttacctttacaagaagaaatgaaatggtctgagtatcttaacacaccatttcttatgcagaatcaaccttctccatcaatgtacactgaagctaaaccagaaacaggtttcataacagatgaatcatgtactagttggcagcagcagcaacaacaaaattttcaactttctgatatatatagcaaggatctgcagagattttcagtggcttttggacaaagtatgtag

SEQ ID NO: 251 - protein, 312 aa, Oryza sativa
MGRLSSCGGVQAKLRKGLWSPEEDDKLYNHIIRHGVGCWSSVPKLAGLQRCGKSCRLRWINYLRPDLKRGSFSQQEEDLIVALHEILGNRWSQIASHLPGRTDNEIKNFWNSCLKKKLRQRGLDPATHKPIAAAAAAATSSESAVTQVDEDHKPHGAAAAAAAADGLAANAKQSVFDPFPVTDFGAGFDLGAANMAAALYGSHPDDGAGFVADYSSVLDVSENLGYGESSSNSSNWTCAEVSNVLDSEVLNWAASAGADAAAKAEPFADMEQQHSGYGGEYQVEDDATLEHKFSLPCHEQSLAQFDFNLEYF

SEQ ID NO: 252 - DNA, 1323 bp, Oryza sativa
gaggagaagggttatagaggctgatcgaccatcgatcgacgtcgtggcgagcggctagtgttcgttgtcgtcgtcggcggcggcgaggtggtggtggtggtagctacgtaggttgtggacatcgatctagaggtagaggcagggagggggaggaatgggacggctgtcgtcgtgcggcggcgtgcaggcgaagctgaggaaggggctttggtctcccgaggaagacgataagctgtacaatcacatcatccgacatggcgtcggctgctggagctccgtccccaagctcgcagggttgcagcgatgcggcaagagctgcaggctgcggtggatcaactacctcaggccagacctgaagcgcgggagcttctcgcagcaggaggaggacctcatcgtcgcgctgcacgagatcctcgggaacaggtggtcgcagatcgcgtcgcacttgccggggaggacggacaacgagatcaagaacttctggaacagctgcctcaagaagaagctccggcaacgcggcctcgacccggccacgcacaagcccatcgccgccgccgccgcggcggcgacgtcctcggagtcggcggtcacccaggtggatgaggatcacaagccccacggcgccgccgccgccgccgccgccgccgacggcctcgccgcgaacgccaagcagtcggtgttcgacccgttcccggtgaccgacttcggcgccggcttcgacctcggcgcggcgaacatggcggcggcgctgtacggctcccaccccgacgacggcgccgggttcgtcgccgactacagcagcgtgctcgacgtgtcggagaacctgggctacggcgagagctccagcaacagcagcaactggacctgcgccgaggtgagcaatgtgctcgacagcgaggtgctcaactgggccgcctcggccggcgccgacgccgccgccaaggcagagcccttcgccgacatggagcagcagcacagtggctatggcggcgagtatcaggtggaagacgacgccacgctggagcacaagttctcgctaccatgccatgagcagagcttggctcaattcgacttcaacttggaatacttctgatcaattaatttttaccactccttttttttaccacactacagtatattctacacgtacaggataaagaaccattggaagattaggattgttattattattattactactactacatgttaattttctctagcccggactctactcacactgtttcttttttctttttttttttgagaaaatgtatactgtttttctggttggttagaataagagacattactactatacac

SEQ ID NO: 253 - protein, 146 aa, Populus trichocarpa
MGRHSCCYKQKLRKGLWSPEEDEKLLRHITKYGHGCWSSVPKQAGLQRCGKSCRLRWINYLRPDLKRGTFSQQEENLIIELHAVLGNRWSQIAAQLPGRTDNEIKNLWNSCLKKKLRQRGIDPVTHKPLSEVENGEDKNPPASGTQ

SEQ ID NO: 254 - DNA, 438 bp, Populus trichocarpa
atggggaggcactcttgttgctacaagcagaagctaaggaaaggcctgtggtcgcctgaggaagatgagaaactcttaaggcatatcaccaagtatggccatggttgttggagctctgtcccaaagcaagctggtttgcaaaggtgtggcaagagctgcagactaaggtggattaattacttgaggcctgatttgaagagaggcacattctcacagcaggaagagaacctcataattgagcttcatgcagttctaggaaataggtggtctcagattgcggcacaattgcctggaaggacagacaatgaaataaagaatctatggaactcctgcttaaagaaaaaacttcggcagagaggcattgaccctgttacccacaaaccactttctgaggttgaaaatggagaagacaagaatccacctgctagtggcacccaa

SEQ ID NO: 255 - protein, 420 aa, Arabidopsis thaliana
MAASQTFSLLAFTFSLLAFASTVSSHNITQILADSPDYSSFNSYLSQTKLADEINSRTTITVLVLNNGAMSALAGKHPLSVIKSALSLLVLLDYYDPQKLHKISKGTTLSTTLYQTTGNAPGNLGFVNITDLKGGKVGFGSAASGSKLDSSYTKSVKQIPYNISILEIDAPIIAPGVLTAPAPSASLSNITGLLEKAGCKTFANLLVSSGVLKTYESAVEKGLTVFAPSDEAFKAEGVPDLTKLTQAEVVSLLEYHALAEYKPKGSLKTNKNNISTLATNGAGKFDLTTSTSGDEVILHTGVAPSRLADTVLDATPVVIFTVDNVLLPAELFGKSKSPSPAPAPEPVTAPTPSPADAPSPTAASPPAPPTDESPESAPSDSPTGSANSKSANAAVGVSTPSLFTALVTIAAIAVSVSLCS

SEQ ID NO: 256 - DNA, 1572 bp, Arabidopsis thaliana
ccacttcctctgctccacactgacacttgaaaaaactcaaaaccgtctcatcatggcggcgtcacagacattctcactcctcgccttcactttctccctcctcgcctttgcttccaccgtgagtagccacaacatcactcaaatcctcgctgattctccagattactcttccttcaacagctacctttctcagacgaagctcgccgacgagatcaacagccgcacgacgattacagttctcgtccttaacaatggcgcaatgtctgctctcgccggaaaacatccactctccgttattaaaagcgctttaagcctcctcgtcctcctcgattactacgatccacaaaaactccacaagatctccaaaggcacaactctctccaccacactttaccaaaccaccggaaacgctcccggaaacctaggattcgtcaacatcaccgatcttaaaggaggcaaagtcggatttggctccgccgcttcaggttccaaactcgattcatcttacaccaaatccgttaaacaaatcccttacaacatctcaatcctcgagattgatgctccgatcatcgctcccggagttttaaccgctcctgctccttccgcctccttgtcaaacatcaccggattactcgaaaaagccggttgcaaaacctttgctaatttgcttgtctcaagtggagtactcaagacttacgaatccgccgttgaaaaaggcttgacggtttttgcaccgtccgatgaagcttttaaagctgaaggtgtaccagatctgacgaagctcacacaagctgaggtagtctcgctcttagagtatcacgccctcgctgagtataaacctaaaggctcattgaagactaacaagaacaatatctccacgttagccactaacggcgccggaaaattcgatctaacgacctctacctccggcgacgaagttattctccacaccggcgttgctccgtcgagactcgcggacactgtgctcgacgcgactccggttgtgatattcactgtggataatgtccttctccctgctgagctattcggaaaatctaaatctccatctccggcaccggcgcctgagccagttaccgcaccgacaccatctccagcggatgcaccttcacccaccgcagcttcaccaccggcacctccgacggacgagtcaccggaaagtgctccttcagactcgccaacaggttcagcgaacagtaagtcagctaacgcagcggttggcgtgagcacaccgtcgttgttcaccgcattggtcacgatcgccgccatagccgtctccgtgtctctctgctcttaaaacctttcgtaattacgcaggctgccactccctttgtttatttttaatttaattatcttttcaatttttatttttgtggttatgtgttgttgagtttgaaaacatgggattagtgagtgaggttttatttaaatcgtttgttaatcacattttcattattgctttcagtgttgatctgatagtatcttgttgagatctttggctttcacttatttaacttcttttccatttttggataaagtgctttttcttctaat

SEQ ID NO: 257 - protein, 401 aa, Oryza sativa
MAAAAQRLVAAVVVLVACLALPAARGLNITAMLNGYPDYKMFNKYLSETKVCDEINARESITLLVLGDGPMSTLVLDADQSLAGIKNALRLHAILDYFDPKKIRGLPDADTMTDTLYQAGGDAAGKMGNVKISTLDTGKIAFASANPGGKYEATMVKAIKQMPYKLSIMEISAPIEFDGLFDTPSATNLTRLLEKAGCKRFASLITSTGVLKTFEDAMDKGLTLFAPNDDAFDAKGAPDVKKMPSADLVTLLKYHALPSYNPKPTLKTVSRAMRTLASTASGKYNITVDTRGDAVTLNTGVDKSRVAATVIDDTPVCVLTVDNLLMPVELFGDAPAAAPSPDDAAPAPSPSVADASPPAPPPADAPSKPADHKEMKASSAVALRSVVLGALAAAVCSFVLL

SEQ ID NO: 258 - DNA, 1595 bp, Oryza sativa
gcggcctcaccaaccaccacgcaaacccattgttaattaattagcggcacactgtcacggcgcattatttgctagctccagtgacagctcactcctcttcttgctgctgagggcttagctagccagtccacctcgtcggtgtgtgtcggtgtagtctagcagctgcggcgggaggaggagttgccggccggagatggcagcggcggcgcagcggcttgtcgccgctgtcgtcgtcttggtggcctgcctggcgttgccggcggcgcgggggctgaacatcacggcgatgctgaacgggtacccggactacaagatgttcaacaagtacctgtcggagacgaaggtgtgcgacgagatcaacgcgagggagtcgatcacgctgctcgtcctcggcgacgggccaatgtcgacgctcgtcctcgacgccgaccagtcgctggcgggcatcaagaacgcgctccgcctccacgccatcctcgactacttcgacccgaagaagatccgtggcctccccgacgccgacacgatgaccgacacgctctaccaggccggtggggacgccgccggcaagatgggcaacgtcaagatctccaccctggacaccggcaagatcgccttcgcgtccgccaacccggggggaaagtacgaggccaccatggtcaaggccatcaagcagatgccgtacaagctctccatcatggagatctcggcgcccatcgagttcgacggcctgttcgacacgccgtcggcgaccaacctgacgaggctgctggagaaggccgggtgcaagcggttcgcgtcgctcatcaccagcaccggcgtgctcaagacgttcgaggatgccatggacaaggggctcaccctgttcgcgcccaacgacgacgcgttcgacgccaagggcgcccccgacgtcaagaagatgcccagcgccgacctcgtcacgctcctcaagtaccacgcgctgccgtcgtacaaccccaagccgacgctcaagacggtgtcgcgcgccatgcgcacgctggcgtccaccgcgtcggggaagtacaacatcacggtggacacgcggggcgacgccgtgacgctcaacacgggcgtcgacaagtcccgcgtggcggccaccgtcatcgacgacacgccggtgtgcgtgctcacggtggacaacctcctcatgccggtcgagctcttcggcgacgcgccggcggcggccccgagcccggacgacgcggcgcccgccccgtcgccgtcggtcgcggacgcgtctccgccggcgccgccgccggccgacgcgccgtcgaagccggcggatcacaaggaaatgaaggcgtcgtccgccgtcgcgttgcggtcagtagtgctcggcgcattagccgcggccgtgtgttccttcgtgctgctttaagcacaagtttttttttccctttcttccatgtccagtgccggtgattgtgattgcacgagctgcattgccaattattcctctgtataatgcgagcaaactgtgtacattttgttctaattctgatatccttttctccgaatcgtctgcgccatttcggtgcggtgaatttggaagaattcatgtcgcgttgagctgt

SEQ ID NO: 259 - protein, 421 aa, Populus trichocarpa
MATLQYSLLLSFTLSALVSTILAHNITDILSGFPEYSEFNKYLTQTKLADEINTRQTITVLALNNGAMTALAAKHPLSVIKNALSLLVVLDYYDPTKLHQISKGTTLSTTLYQTTGNAPGNLGFVNITDLQGGKVGFGSAAPGSKLDSSYTKSVKQVPYNISILEISQPIIAPGILTAPAPTPSSVNITALLEKAGCKTFASLLQTSGVIKTYQSAADKGLTIFAPNDEAFKAAGVPDLSKLTNAEIVSLLQYHATATYSPFGSLKTSKDPISTLASNGAGKFDLTVTSAGDSVTLHTGIGPSRVAETVLDSTPLVIFTVDNVLLPVELFGKAPSPAPAGEPVSAPSPSPVASSPAPASVEAPSPLAASPPAPPVETPGGAPAETPFGSENSTADGSAAVHVSVPVQVTVFATVICSILMS

SEQ ID NO: 260 - DNA, 1544 bp, Populus trichocarpa
actctcattccctctctcaaaattccaccatggctacgttacagtactctctccttctttccttcacactatcagcactcgtctccaccatcttagcccacaacataaccgacattctctcaggcttcccggaatactccgagttcaacaagtaccttacccaaacaaaactagccgatgaaatcaacactcgccagacaataactgtcttggctctcaacaatggggctatgactgctcttgcagccaaacatccactttcagtcatcaagaatgcccttagtcttcttgttgtccttgattactatgacccaactaaactccatcagatctccaaaggcaccacgttatccaccactctctaccaaactactggaaatgcccctggtaacctcggattcgtcaacattacagatctccaaggtggtaaagtcggcttcggctccgctgctcccggctcgaaacttgattcctcttacactaaatctgtgaagcaagtcccttataatatttcaattcttgaaatcagccagccgattatagctccagggattttaacagctccggccccaacaccgtcaagtgtgaacattacggcgttactcgaaaaggctggatgcaaaacatttgcgagtttgttacaaactagcggtgtcattaaaacgtatcagtcagcggcggataaaggtttaactatttttgctccaaacgacgaggcgttcaaggctgctggagtacctgatctgagcaagctcaccaatgctgaaatagtctcgctcttacagtaccatgccacggctacttacagtccgtttgggagtttgaaaactagcaaagacccgatctctacgttggctagtaacggtgcaggtaagttcgatctgacggttacaagtgcgggtgactcggtgactctacacactggaatcggtccgtcgcgagttgctgaaacggtccttgactcaacaccgctagtgattttcactgttgataatgtgctgctaccggttgagttgttcgggaaagctccgtctccagccccggcaggggaaccggtgagtgcaccgagtccgagtccggttgcatcgagtccagctccggctagtgttgaggctccatctcctctcgctgcttcaccccctgctccgcctgtggagacgcctggtggtgccccagctgagacgccgtttggatccgagaatagcacggcggatggtagtgctgctgttcacgtgagtgtacctgttcaggtcactgtctttgccactgtaatttgttcgattctcatgtcctgaatcgtaattatctagctcagttaatttgctttttatttattattggattttgagttgttattttgttagagaggattatttttattattaatttattttgtttttgaatttatcagtgatgaggtgatgtgaggtgaggtgagtcagctgcgcattttagcggcagtacatttcctattgttgtattcattcatcgagtgctacgcgttacattattttaatgtagggatctgttcgtttttctgtgat

SEQ ID NO: 261 - protein, 392 aa, Sorghum bicolor
MATQRLVAALVACLLVLAALPVRGRNITAILQGYKEYKLYNQYLSETKVCDEINSRQSTSMTILVLSNDAMTTLAKDAGDSLPAIKNALRLHSVLDYYDRKKVKKYGDESAATLYQATGDAAETTGNVKVVDQEDKNYGFSAATAGARICTVTKEVETHPFKFAILEVTAPIEFDGLFDVPSTANLTRLLERAGCKVFASLAASTGVLKSYEDAMDKGLTLFAVNDDAFSAKDVPDVKTMSKANLTKLLQLHALPSYNTKTSLKSVKGSLRTLAPKDDVKVVAKGDDVSLDTGKTRSRVASTVVDSVPFCLLTMDSLLVPPELYVGAPEAAPAPAPVDAPQGSPPAADAPSVAADHADHKSKKSTASSAVASRPVAALAATAVCSVVLASLL

SEQ ID NO: 262 - DNA, 1581 bp, Sorghum bicolor
ctactgggttattagccatagccagtggcctgtgacaggctagcagcagctctgctcatcagtcatcactagctcgtcttcgccttcctatcagggtgtgtagtgtgtgtgtgagagagagccatggcgacgcagcggctcgtggcggcgctggtggcctgcctcctggtgctggcggcgctgccggtgcgcgggcgcaacatcacggccatcctgcaggggtacaaggagtacaagctgtacaaccagtacctatcggagacgaaggtgtgcgacgagatcaactcgcggcagtcgacgtcgatgaccatcctggtgctctccaacgacgccatgacgacgctggccaaggacgccggggactcgctccccgccatcaagaacgcgctgcgcctccactcggtgctcgactactacgaccgcaagaaggtgaagaagtacggcgacgagagcgccgccacgctgtaccaggccacgggcgacgccgcggagaccacgggcaacgtcaaggtggtggaccaggaggacaagaactacggcttctcggcggccaccgcgggcgccaggatctgcaccgtcaccaaggaagtggagacgcacccgttcaagttcgccatcctcgaggtcacggcgcccatcgagttcgacggcctcttcgacgtcccttccaccgccaacctcacccgcctcctggagcgcgccggctgcaaggtgttcgcgtcgctggccgcctccacgggcgtgctcaagtcgtacgaggacgccatggacaagggcctcaccctgttcgccgtcaacgacgacgcgttcagcgccaaggacgtgcctgacgtcaagaccatgtccaaagccaacctcaccaagctcctccagctccacgccctgccttcctacaacaccaagacgtcgctcaagtccgtcaagggctcactccgcacgctggcccccaaggacgacgtcaaggtggtcgccaagggcgacgacgtctcgctcgacaccggcaagaccaggtcccgcgtcgcgtccacggtcgtcgacagcgtcccgttctgcctcctcaccatggacagcctcctggtgccgccggagctctacgtcggcgctccggaggcggcaccggcgcctgcgccggtggacgcgccacaggggtccccgcccgcggcggatgcaccgtcggtggcagcggaccacgcggaccacaagtccaagaagtctacggcgtcgtccgccgtcgcgtcgcgcccggtcgccgcgctcgccgcgacggccgtgtgttccgtcgtgctcgcgtccctcttgtgattgcgacgcaatgcaactgagagaacattttggctacctccggctgctggcagcacatccatccactgttgcttggcagctcctccgatctctacttctgcctcctccaatccaagcagataccccgtttccctgtgatctctctcctccgctctgttccggccgttggttgattgaatttgttggtgcattgccattttcccatgtaatttgagcaaaaaaaaacatgtacatttcccccggcaacgtatcatatgcaactcatcttcgtgtgcaacc

SEQ ID NO: 263 - protein, 297 aa, Arabidopsis thaliana
MRTKSPSSLNLKVIFIGSSILILIIIYLARSNISSSSSKPISKTNLSQEEEETQHKQEGCPTTQQCTKMPLSLSDALVHYVTSNVTPQQTFDEVSVSKRVLDKKSPCNFLVFGLGHDSLMWASLNHGGRTLFIEEDQAWIAIVTKKFPNLESYHVVYDTKVKDSDKLMELGRSEECRSVSDPRNSKCDLALKDFPADFYETKWDLIMVDAPTGYHEEAPGRMSAIYTAGLLARNREDGETDVFVHDVNRPVEDEFSATFLCKGYMREQNGRLRHFTIPSHRARAGRPFCPVEVDRRR

SEQ ID NO: 264 - DNA, 1216 bp, Arabidopsis thaliana
atcttcctcattcatagatccaaaaacccaaatcgaaaaatcgattctttagtcagaaaaaatgaggaccaaatctccatcttctcttaatctcaaggtcatattcataggttcctcaatcttgatcttgatcatcatctacttagcaagatcaaacatctcttcttcctcttcaaagccaatctccaaaacaaatctctcccaagaagaagaagaaactcagcataaacaagaaggatgtccaacaacacaacaatgcacaaagatgccactttctttatccgatgcattggttcattacgtcactagtaacgtcactccacaacaaacatttgatgaagtctctgtctcaaagagagtcttggacaagaagtctccttgtaacttccttgtctttggcttaggtcacgacagtttaatgtgggcatctcttaaccatggtggtcgtaccttgtttattgaagaagaccaagcttggattgcgatagtaactaagaagttcccaaacttagaatcttaccacgtagtttacgacacaaaagtcaaagattcagacaagctgatggaactaggaagatcagaagagtgtagatctgtgtctgatccgagaaactccaaatgtgatcttgcgttgaaagatttcccggcggacttttacgagacgaaatgggatctgatcatggttgatgcaccaactggttaccatgaagaagctccggggaggatgagtgctatttacacggcggggcttttggctcgtaaccgtgaagatggtgaaactgacgtttttgttcacgacgttaaccgtccggtggaagatgagttctcggcgactttcttgtgtaaaggttatatgagggagcaaaatgggagacttagacattttactattcctagtcatcgggctcgtgctggacgacctttttgtccggtggaagttgatcgccgccgttaattttgtggtgggagatttatttagttcaccgtcgttggtcggtcaacggactcagggctggtaaattgttttacctagtggacattgaaggacttgcttagctggcattttgtatttgttttgttttgtttttgcttgatttaaatacgtttttcaagattttagtgcatttactgaaatcgatacatactagtattcgcatgattatttgtgatttcattatcccttttgattaatgaatacaaataaggaatttatctg

SEQ ID NO: 265 - protein, 298 aa, Medicago truncatula
MRSKTQLSSNLKLVIISLVFLFLFIMLFKSSIFSFTQPLTTTSNTNNDSKISSQETEKTTKSECPSLPITPTCTKNPPSLANALIHYATTKITPQQTIQEISVSAKVLQKKSPCNFLVFGLGHDSLMWTSLNYGGRTVFLEEDKTWIEQIQSKFPTLESYHVVYDTKVHQSDELMKIGMEQEDCKKVSDPRFSKCGLALKGFPSEIYDVEWDVIMVDAPTGYFDGAPGRMSAIYTAGLIARNRENGDTDVFVHDVDRKVEDQFSKAFLCEGYLREQEGRIRHFNIPSHRARLGRPYCP

SEQ ID NO: 266 - DNA, 897 bp, Medicago truncatula
atgagatccaaaacacaactctcatccaatctcaaactagtcatcatctctcttgtatttctctttctcttcatcatgctattcaaatcatccattttctcatttactcaaccactcaccacaacttcaaacaccaacaatgactcaaaaatctcatcgcaagaaacagaaaaaaccacaaaatctgaatgtccttcactccctataacaccaacatgcacaaaaaaccctccatcattagccaatgcattaatccattatgcaacaacaaaaatcacccctcaacaaacaattcaagagatctcagtctcagccaaagttcttcaaaaaaaatcaccttgcaacttcttggtctttggattaggtcatgatagtctcatgtggacatcattaaactacggcggccggaccgttttccttgaagaagacaagacatggattgagcaaatccaatcaaagttcccaacgttggaatcatatcatgttgtgtatgatacaaaagtacatcaaagtgatgaactaatgaaaattggaatggaacaagaggattgcaaaaaagtttctgacccaagattttcaaaatgtggattagcacttaaaggatttccaagtgaaatttatgatgtggaatgggatgtgatcatggtggatgcaccaacggggtacttcgatggcgcgccggggaggatgagtgctatttatacagctggtttgattgctaggaatagagaaaatggtgatactgatgtgtttgttcatgatgttgataggaaagttgaggatcaattttcaaaggcttttctttgtgaaggttatttgagggaacaagaaggaaggattaggcacttcaatataccaagtcatagggctcgtttgggtagaccttattgtccatga

SEQ ID NO: 267 - protein, 295 aa, Oryza sativa
MSSPMHVRKAIHFVSMKAKLQSFGGLRLLLVGCLAALLLLFAVRTLSFTTSSATATAAREAAEAGCGKLPAAVAQAMVHYATANVTPQQTAAEIGVSLRVLQLRAPCNFLVFGLGLDSAMWAALNHGGRTVFLEEDASWIASVKAGHPGLESYHVAYDTRVTDADELIALRHEPACTSQPDLAAAAAASCRLALRGLPPVFHEVEWDLIMVDAPTGWTPESPGRMGAIYTAGMAARARTPGAGATEVFVHDVDRHVEDTFSKAFLCDGYLVEQVGRIRRFVIPSHRDKDGTPFCP

SEQ ID NO: 268 - DNA, 1790 bp, Oryza sativa
ctgcaattaatcaatctgttaatctgttattagtagttactactaacaattatagagtatattaattaatttaagctaaaaaaatggggcccacaaagcagaggaagagaacccatccatccaaccattcataaaatctatctagaattccaacttaacaccaaatctattggtctcttgtcctcatcaccaaaccccatcttcatcgtcgtcatcttcaacccccatccccatatcttcctttgcctctccttcaagcatcatcaccaagtaaaaagagaaaaagaacccataaatttgaagaattttagcttcattcaagaactcgatcgaggagggccaagaaaggtgtgagaccttgatttggtcgccatgtcgagccccatgcatgttcgcaaggcgatccacttcgtctccatgaaggccaagctccagagcttcggcggcctccgcctcctcctcgtcggctgcctcgccgcgctgctgctgctgttcgccgtcaggacgctgtcgttcacgacgtcgtcggcgacggcgacggcggcgagggaggcggcggaggcgggctgcgggaagctcccggcggcggtggcgcaggcgatggtgcactacgcgacggcgaacgtgacgccgcagcagacggcggcggagatcggggtgtcgctgcgggtgctgcagctgcgggcgccgtgcaacttcctggtgttcggcctgggcctcgacagcgccatgtgggcggcgctcaaccacggcggccgcaccgtgttcctcgaggaggacgcgtcctggatcgcctccgtcaaggcgggccacccggggctcgagtcctaccacgtcgcctacgacacccgcgtcaccgacgccgatgagctcatcgccctccgccacgagccggcctgcacgtcccagccggacctcgccgccgccgccgccgcgtcgtgccgcctcgccctccgcgggctcccgccggtgttccacgaggtggagtgggacctcatcatggtggacgcgccgacggggtggacgccggagtcgccggggaggatgggggcgatctacaccgcgggcatggcggcgcgcgccaggacgcccggggcgggcgccaccgaggtgttcgtccacgacgtcgaccgccacgtcgaggacaccttctccaaggcgttcctctgcgacggctacctcgtcgagcaggtggggcgcatccgccgcttcgtcatccccagccaccgcgacaaggacggcacgccgttctgcccttgatgagagatgagcttcgccttcgccttcgccgcgcacatggacaccgtgatgacaccattgccatcgtcgtcttcttcatcttcttcatcttcttcttcacatatgacaccaccattgctgccgtcatcgtcttcttgaattcacatgtcttttgtgatgatcaaggataagtaggatgatgagtgcacctttgggatcatgcaccaatggaggcggtggcgcgatgcgtgtgagccgtcggatcgagaacggacggttcggatcggaccgtggagatattgttattatatatagtttcttttttttttcaaatgcagctttttctttgttgttttttttatggacggtgggtgagatggatatgcaggcgaattataattcttggctatttttcatagattatcgttgtgtttctttttaattcataattgagatatcatcttcagtgggtgactgatgagtggtgccatttgagattcctatctactgaagcaataatgctaagatagaaacttacataatttgttgag

SEQ ID NO: 269 - protein, 226 aa, Populus trichocarpa
TCTKTPPSLANALVHYVTTNITPQQTLKEISVTLRVLEKKSPCNFLVFGLGHDSLMWTSLNHGGRTVFLEEDKAWIEQITEKLPSLEAYHVTYDTRVHQADGLMETGMGDECKVVSDPRFSKCQLSLKGFPSDIYDMEWDLIMVDAPTGYHDEAPGRMTAIYTAGLMARNRENGETDVFVHDVDRVVEDKFSKAFLCEGYLTEQEGRLRHFIIPSHRTRSGRPFCP

SEQ ID NO: 270 - DNA, 678 bp, Populus trichocarpa
acatgcaccaaaaccccaccttctttagccaatgctcttgtccattacgttacaacgaacatcaccccacaacaaaccctcaaagaaatctcggtcacattaagggtcctggagaaaaagtcaccttgcaatttcctagtctttggtcttggtcatgacagtctaatgtggacatctctaaatcatggtggccgaactgttttcctggaagaagacaaggcttggattgagcaaatcacagagaaactgccctctttagaggcctaccatgtgacgtacgacaccagagtgcatcaggcagatgggctcatggagacaggaatgggagatgaatgcaaagttgtaagcgaccccagattctccaagtgccagctttctcttaaagggttccctagtgatatttatgacatggaatgggacttgatcatggtggatgcacccactgggtatcatgacgaggcaccagggaggatgactgcaatctacacggctggattgatggctaggaacagagagaatggagagactgatgtgtttgtgcatgatgttgatagagttgtggaggataaattctccaaggcttttctttgtgaaggatacttgactgagcaggaagggaggttaaggcatttcatcattcctagtcatagaactcgttcgggcagacctttttgtcct

SEQ ID NO: 271 - protein, 234 aa, Populus trichocarpa
CPSLPLTPTCTKIPPSLANALVHYVTTNITPQQTLKEISVSLRVLEKKSPCNFLVFGLGHDSLMWTSLNHGGRTVFLEEDKAWIEQIREKLPTLESYHVTYDTRVHQADGLMETGMGDECKVVGDPRFSKCQLALKGFPGDIYDVEWDLIMVDAPTGYHDEAPGRMNAIYTAGLMARNRENGVTDVFVHDVDRVVEDKFSKAFLCEGYMTEQEGRLRHFIIPTHRTSSGKPFCP

SEQ ID NO: 272 - DNA, 702 bp, Populus trichocarpa
tgtccttctcttccattgacgccgacatgcaccaagatcccaccttctttagccaacgctcttgtccattatgtgacaacaaacatcaccccacaacaaaccctcaaggaaatctcagtctcattaagggtcctcgaaaaaaagtcaccttgcaacttcctagtctttggccttggccatgacagtctaatgtggacatctctaaatcacggcggccgcactgttttcctggaagaggacaaggcctggattgagcagatcagagagaaactgcccaccttggagtcctatcatgtgacatacgacaccagagttcatcaggcagatgggctcatggagacaggaatgggagatgaatgcaaagtagtcggtgatccaagattctccaagtgtcagcttgcccttaaagggttccctggtgatatctatgatgtggaatgggacttgatcatggtggatgcacctactgggtaccatgatgaggctccagggagaatgaatgcaatctacacagctggattgatggctagaaacagagaaaatggagtgactgatgtgtttgtgcatgatgttgatagagttgtggaggataaattctccaaggcttttctttgtgaaggatacatgactgagcaagaagggaggttaaggcacttcattattcctactcatagaactagttcgggaaaacctttttgtcca

SEQ ID NO: 273 - protein, 311 aa, Arabidopsis thaliana
MYKASPKRKEIVEKSKSVREKEIKQNSNFFAKHLKRIYPITLQRSTSSSFSLSSISLSLSQNSTDSVSTDSNSTLEQKISLALGLISSPHRREIFVPKSIPQQLCQDFNSSDEPKRCNWITKKSDEVYVMFHDQQWGVPVYDDNLLFEFLAMSGMLMDYNWTEILKRKEHFREAFCEFDPNRVAKMGEKEIAEIASNKAIMLQESRVRCIVDNAKCITKVVNEFGSFSSFVWGFMDYKPIINKFKYSRNVPLRSPKAEIISKDMIKRGFRFVGPVIVHSFMQAAGLTIDHLVDCFRHGDCVSLAERPWRHI

SEQ ID NO: 274 - DNA, 1004 bp, Arabidopsis thaliana
gatgtataaggcaagtcctaaaagaaaagagattgtagagaaaagcaagagtgtaagagagaaggagattaaacaaaactcaaatttctttgccaaacacttaaagaggatttacccaatcacgcttcaacgaagcacttcttcttcattttcactctcttctatatctctatcactctctcagaactcgaccgattctgtttccacggattcaaattcgacgttggaacaaaagatctctctggcactcggtttaatctcatctccccacagaagagaaatatttgttccaaaaagtatcccacaacaactatgtcaggatttcaatagtagtgatgaaccaaagaggtgcaactggatcaccaagaaaagtgacgaagtctacgtaatgtttcatgaccagcaatggggagtccctgtctatgatgataacctgctttttgagttccttgccatgtcggggatgttaatggactataactggaccgagattctaaaacgcaaagaacactttagagaggcattttgtgagtttgacccaaatcgggtggccaaaatgggagagaaagagatcgcagagattgcatcaaataaagcaataatgttacaagagagtagagtcaggtgtatagtcgacaatgccaaatgcataaccaaggtggtcaatgaatttggatcattcagcagcttcgtttgggggtttatggattacaaacctatcattaacaaattcaagtattcaagaaatgtaccattgagatctcctaaggctgagataattagcaaagatatgatcaaacgagggtttcgatttgtcggtccagtgatcgtacattcgttcatgcaggctgcagggttaacaattgatcacctcgtcgattgttttagacatggtgattgtgtgagcctcgctgagaggccatggaggcatatatgatatatttggatagagattctaatccagtttcggtttaaaacatatcttctggtttttgagttttttt

SEQ ID NO: 275 - protein, 375 aa, Medicago truncatula
MSASGGPRLRSMNVADSEARPVFGPAGNKTGSYSSRKDASKPLRKAEKLGKEVDLAKEKKEASPQSHSASVSSVLRRHEQLLHSNLSMNASCSSDASTDSFHSRASTGRLTRSNSYGLTRKRSVSKPRSVVSDGVLESPPPDGAQPKKRCAWITPNTEPYYATFHDEEWGVPVHDDKKLFEVLVLSSALSELTWPAILSKRHIFREVFADFDPVAVSKLNEKKVITPGTTASSLLSDQKLRGIIENARQISKVIVEFGSFDNYIWSFVNHKPILSKFRYPRQVPVKTPKAEVISKDLVRRGFRGVGPTVIYSFMQVVGLTNDHLISCFRFQECVAAAEGKEENSIKNEDAQPNACDSVMESDLSIAIDNLSLSSE

SEQ ID NO: 276 - DNA, 1128 bp, Medicago truncatula
atgtcagcttcaggaggtcctagattgaggtctatgaatgttgctgactcagaagcaaggcctgtgtttggtcctgctggaaataagacaggttcttatagttctagaaaagatgcttcaaagccactgagaaaggctgagaaattgggcaaggaggttgatttggccaaagagaagaaagaagcttctcctcagtcacattctgccagtgtttcttcagtgttgcgccgacacgagcagttgttgcattctaatttgtcgatgaatgcttcgtgttcttcagatgcatcgaccgactcatttcatagccgagcttctactggaagattgactcggtctaatagctatggtttgacaaggaagcggtcagtgtcaaagccaagaagtgttgtttctgacggtgtgttggaatctcctcctcctgatggtgcacaacccaagaagaggtgtgcttggatcactcctaatactgagccatattatgctactttccatgatgaagaatggggagttccagtacatgacgacaagaaactgtttgaggttcttgttctttcgagtgctctatctgaactcacttggccagccattctaagcaagagacacatttttagggaagtttttgctgactttgatccagttgctgtctcaaaattaaatgagaagaaagtgataacaccaggaaccactgcaagttccttactctctgatcagaaattgcgtggaataattgagaatgcacgccaaatatcaaaggtcatagtagagtttgggtcatttgacaattacatttggagttttgtgaaccacaagcctatacttagcaaattccgatatccccgacaggttcccgttaaaacgccaaaagctgaagttattagcaaagacctggtgagaagaggtttccgtggtgtgggtcccacggtcatatactccttcatgcaggtagtggggttaactaatgaccacctcattagttgcttcagatttcaggaatgtgtggctgcagcagaagggaaggaggagaattccatcaagaatgaggatgctcaaccaaatgcatgtgatagtgtgatggaatctgatctttccattgccattgataatttgagtttgtcctcagaatga

SEQ ID NO: 277 - protein, 339 aa, Oryza sativa
MLTTSSHSRHHHAFERSPNHSMMKNIADRNKHDLLQSAMNHAASKYMQRIYPLGIQRSSSNLTLSSLSLSQNSNDSSLSSSNSSWEPKVPLLYGGTFSPWGDVLVSLERRREEDDDKVSDHDVEGGEEDFDCSEPGSLHRCSWITKNSDEAYVQFHDECWGVPVYNDNRLFELLALSGMLIDHNWTEILKRRDMYREAFADFDPSTVAKMDENDVAEISGNKELKLAECRVRCIIENAKCIQKVAKEFGSFSGYIWGHVNHRPTVGRYKHHKYIPFRTPKSEAVSKDLVRRGFRLVGPVIVYSFMQASGIVIDHLVDCFRFPECLHLADRSWGITNVAA

SEQ ID NO: 278 - DNA, 1662 bp, Oryza sativa
attgcaaaaccacccattctccttgaatcttgcctccaaaaactcttgccacttagcattcacaatgctcaccacatcatcacatagcaggcaccaccatgcatttgagaggagccccaaccacagcatgatgaagaacatagcagacaggaacaagcatgatcttcttcagagtgccatgaaccatgcagcaagcaagtacatgcagaggatctaccctctggggatccagaggagcagctccaacctcacactctcatcactctccctgtcacagaactccaatgattcttcactcagcagctcaaactctagctgggagcccaaggtgcccctgctgtatggtggcacatttagcccctggggtgatgtgcttgtgtccctggagaggaggagggaagaagatgatgacaaggttagtgatcatgatgttgaggggggagaagaggattttgattgcagtgagcctgggagcttgcataggtgcagctggatcaccaagaacagtgatgaggcgtacgttcagtttcacgacgagtgctggggtgtcccagtgtacaacgacaaccgtctgttcgagctgcttgcgttgtcaggcatgctcatcgaccacaactggactgagatactcaagagaagagacatgtacagggaagcgttcgcggacttcgatcccagcacggtggcgaagatggacgagaacgacgtcgcggagatcagcggcaacaaggagctcaagctggccgagtgcagggtccggtgcatcatcgagaacgccaaatgcattcagaaggtggcgaaggagtttgggtcgttcagcggatacatatgggggcacgtgaaccaccggccgacggtggggaggtacaagcaccacaagtacatcccgttccggacgcccaagtcagaggcggtgagcaaggacctcgtccgccgcggcttccgcctcgttggccccgtcatcgtctactccttcatgcaggcctccggcatcgtcatcgaccacctcgtcgactgcttccgcttccctgaatgcctccacctcgccgaccgctcctggggcattaccaacgtcgctgcctaatgacaaaaaaaaaaaaaaaaaccttgaacttttctgccgctcgcgagctcgacagtgttgcaaatagcttagctgtgttcattgcatgttgcagcggccagcaaagctgctacactatactaaaatattgggcgaggcgggtgcaccgtagatgcagtagtgcagttgaacaagccgaagacttttggtgtggcaaatcaaacctcaaattcaaattcccccacttgaaaatttctttttgtttggtttttcactctggggattggcgatgcttggatgtattgtgtagtagggtagggctaagtttttttttttttggttgctcactcccacttggaaagtggtgtagtgagttgttagtggatggtttgtaagaataagttaagatttccttctgtttgggcttaactggggtgttgcatgagaatggagcccacaatgaactcacatgttcagcagaataggttgctccatgtgtcaatgggtggcatttctccgaagattcttggtttacattagcccattttgtatgaatattaagtgtttacgtttaccaccccaacaaggaggtgccacaa

SEQ ID NO: 279 - protein, 323 aa, Oryza sativa
MLTTSSHSRHHHAFERSPNHSMMKNIADRNKHDLLQSAMNHAASKYMQRIYPLGIQRSSSNLTLSSLSLSQNSNDSSLSSSNSSWEPKVPLLYGGTFSPWGDVLVSLERRREEDDDKVSDHDVEGGEEDFDCSEPGSLHRCSWITKNSDEAYVQFHDECWGVPVYNDNRLFELLALSGMLIDHNWTEILKRRDMYREAFADFDPSTVAKMDENDVAEISGNKELKLAECRVRCIIENAKCIQKASGEGVWVVQRIHMGAREPPADGGEVQAPQVHPVPDAQVRGGEQGPRPPRLPPRWPRHRLLLHAGLRHRHRPPRRLLPLP

SEQ ID NO: 280 - DNA, 1664 bp, Oryza sativa
attgcaaaaccacccattctccttgaatcttgcctccaaaaactcttgccacttagcattcacaatgctcaccacatcatcacatagcaggcaccaccatgcatttgagaggagccccaaccacagcatgatgaagaacatagcagacaggaacaagcatgatcttcttcagagtgccatgaaccatgcagcaagcaagtacatgcagaggatctaccctctggggatccagaggagcagctccaacctcacactctcatcactctccctgtcacagaactccaatgattcttcactcagcagctcaaactctagctgggagcccaaggtgcccctgctgtatggtggcacatttagcccctggggtgatgtgcttgtgtccctggagaggaggagggaagaagatgatgacaaggttagtgatcatgatgttgaggggggagaagaggattttgattgcagtgagcctgggagcttgcataggtgcagctggatcaccaagaacagtgatgaggcgtacgttcagtttcacgacgagtgctggggtgtcccagtgtacaacgacaaccgtctgttcgagctgcttgcgttgtcaggcatgctcatcgaccacaactggactgagatactcaagagaagagacatgtacagggaagcgttcgcggacttcgatcccagcacggtggcgaagatggacgagaacgacgtcgcggagatcagcggcaacaaggagctcaagctggccgagtgcagggtccggtgcatcatcgagaacgccaaatgcattcagaaggcgagtggcgaaggagtttgggtcgttcagcggatacatatgggggcacgtgaaccaccggccgacggtggggaggtacaagcaccacaagtacatcccgttccggacgcccaagtcagaggcggtgagcaaggacctcgtccgccgcggcttccgcctcgttggccccgtcatcgtctactccttcatgcaggcctccggcatcgtcatcgaccacctcgtcgactgcttccgcttccctgaatgcctccacctcgccgaccgctcctggggcattaccaacgtcgctgcctaatgacaaaaaaaaaaaaaaaaaccttgaacttttctgccgctcgcgagctcgacagtgttgcaaatagcttagctgtgttcattgcatgttgcagcggccagcaaagctgctacactatactaaaatattgggcgaggcgggtgcaccgtagatgcagtagtgcagttgaacaagccgaagacttttggtgtggcaaatcaaacctcaaattcaaattcccccacttgaaaatttctttttgtttggtttttcactctggggattggcgatgcttggatgtattgtgtagtagggtagggctaagtttttttttttttggttgctcactcccacttggaaagtggtgtagtgagttgttagtggatggtttgtaagaataagttaagatttccttctgtttgggcttaactggggtgttgcatgagaatggagcccacaatgaactcacatgttcagcagaataggttgctccatgtgtcaatgggtggcatttctccgaagattcttggtttacattagcccattttgtatgaatattaagtgtttacgtttaccaccccaacaaggaggtgccac

SEQ ID NO: 281 - protein, 197 aa, Populus trichocarpa
  VARIANT 113: Xaa = Any Amino Acid
GELKRCNWITKNSDKVYVAFHDEFWGVPVYDDIQLFELLALSGMLMDYNWTEILKRKELFREAFDGFNPNIVAKKGEKEIMEIASNKAIMLAESRVRCIVDNARCLLKANCKXEFGSFSNYMWGNVNFKPTINRYKYPRNVQLRSPKAEAISKDLLKRGFRFVGPVIVYSFMQAAGLTIDHLVDCYRYGECVSLAER

SEQ ID NO: 282 - DNA, 589 bp, Populus trichocarpa
ggggagttgaagaggtgcaactggattacaaagaacagtgataaagtttatgtagcatttcatgatgagttctggggagttccggtatacgacgatatacaattgttcgagctgcttgcgttgtctggaatgttgatggactataattggacagagatcttgaaaagaaaggaactgttcagagaagcttttgacggattcaatccaaatattgttgcgaaaaagggagagaaagaaatcatggagatagcctccaataaggcgatcatgttggctgagagcagggtgaggtgcatagtagacaatgccagatgcttactgaaggcaaattgcaagggagtttggatcttttagtaactacatgtggggtaatgtaaatttcaaaccaacaatcaacagatataagtatccgagaaatgttcaactaaggtctccgaaagcagaagccattagcaaggatctactgaagcgtggatttcgattcgtcggaccagtgatagtgtactcattcatgcaagcagcagggctgacaattgatcatcttgtagattgttataggtatggtgaatgcgtaagccttgcagaaaga

SEQ ID NO: 283 - protein, 333 aa, Sorghum bicolor
MITTAHSRQQHHAFEKSPGNNHMKSIDRKLQQAMNQAASKYMQRIYPLGIQRSSSNLTLSSLSLSQNSNDSSISSSNSSWEPKVPLLYGGTFSPWGEVMVSREMRREDDDKVSDHDVEGGEEDFDCSEPGSLHRCSWITKNSDEAYIQFHDECWGVPVYSDNRLFELLSLSGMLIDHNRTEILKRRDMYREAFADFDPSEVARMDEDDVAEISGNRELRLAECRVRCIVENAKCIQKVAREFGSFSGYMWGHVNHRPVVGKYRHHKYIPFRTPKSEAVSKDLVRRGFRLVGPVIVYSFMQAAGMAIDHLVDCFRFHDCVRLAERSWGITNVAA

SEQ ID NO: 284 - DNA, 1383 bp, Sorghum bicolor
attggattccaagctcgatctcttcattcattcattcattcatagtctgcctcccaaaacacctgcctcgcgcgtggcagcaagcacagcacgatgatcaccacagcgcacagccggcagcagcaccatgccttcgagaagagccctggcaacaaccacatgaagagcatcgacaggaagctgcagcaggccatgaatcaagcggccagcaagtacatgcagaggatctaccctctgggcatccagaggagcagctccaacctcacattgtcgtcgctctcgctgtcgcagaactccaacgactcctccatcagcagctccaactccagctgggagcccaaggtgcctctgctctatggcggcaccttcagcccctggggcgaggtgatggtgtcccgggagatgaggcgagaggacgatgacaaggtcagtgaccatgacgtcgaaggaggtgaggaggacttcgactgcagtgaaccagggagcttgcataggtgcagctggatcaccaagaacagtgacgaggcgtacattcagttccacgacgagtgctggggcgtccctgtgtacagcgacaaccggctgttcgagcttctgtcgctgtcagggatgctgatcgaccacaaccggacggagatcctgaagcggcgagacatgtacagggaggcgttcgccgacttcgaccccagcgaggtggcgaggatggacgaggacgacgtcgcggagatcagcggcaacagggagctgaggctcgccgagtgcagggtccggtgcatcgtggagaacgccaagtgcatccagaaggtggccagggagttcggctccttcagcggctacatgtggggccacgtgaaccaccggccggtggtgggcaagtaccggcaccacaagtacatcccgttccggacgcccaagtcggaggcggtgagcaaggacctcgtccgccgcgggttccgcctcgtcggccccgtcatcgtctactccttcatgcaggccgccggcatggccatcgaccacctcgtagactgcttccgattccacgactgcgtccgcctcgccgagcgctcctggggcatcaccaacgtcgccgcatagccagccctccggcccctcgtccgtccatggctccaagttttttacacctttttcttggtgttgtttttttttccttttttttttgtttcgagatccggggtaactcttgaattgtgtgtgaaattatgtagagtatatatgctaagttatgatgtaataagtctattaactctctgccaatgaaaagtagtgctggattagtaggactgcaatgtaactagcttcaggcttctgcaagactgcaacagtagtgataagtcctttgtttgtggcatataaaaaagagat

SEQ ID NO: 285 - protein, 393 aa, Arabidopsis thaliana
MSSSSSVRISLSFIFLALLISPAVSQTCKSQTFSGDKTYPHCLDLPQLKAFLHYSYDASNTTLAVVFSAPPAKPGGWIAWAINPKATGMVGSQTLVAYKDPGNGVAVVKTLNISSYSSLIPSKLAFDVWDMKAEEAARDGGSLRIFARVKVPADLVAKGKVNQVWQVGPELGPGGMIGRHAFDSANLASMSSLDLKGDNSGGTISGGDEVNAKIKNRNIHGILNAVSWGILFPIGAIIARYMRVFDSADPAWFYLHVSCQFSAYVIGVAGWATGLKLGNESEGIRFSAHRNIGIALFTLATIQMFAMLLRPKKDHKYRFYWNIYHHGVGYAILTLGIINVFKGLNILKPQDTYKTAYIAVIAVLGGIALLLEAITWVVVLKRKSNNSMKPLRT

SEQ ID NO: 286 - DNA, 1446 bp, Arabidopsis thaliana
actacaagccatccaacaatgtcttcttcttcttccgtaagaatctctctctccttcattttcttggctctgctaatctcaccggctgtgtcacaaacatgtaagtcacagactttttccggcgataaaacttaccctcactgccttgacctccctcaactcaaagccttccttcattattcctatgatgcctctaacacaactctggccgtcgtcttctctgctccgccggcaaagcctggcggatggatcgcgtgggcgattaatccaaaggctaccggtatggtcggatctcaaacccttgtcgcttacaaggatccaggtaatggtgttgccgtggtgaagacgctaaacattagctcctatagctcgctgattccgtcgaagctggcgtttgatgtttgggatatgaaagccgaggaggcggcgagagatggaggaagtttgagaatctttgctagggttaaggttccggctgatttggtggcaaagggaaaggttaatcaggtttggcaagttggtcctgaattaggtcctggtggaatgattgggaggcacgctttcgactcggcgaatctcgcttctatgagctctcttgatttaaaaggtgacaacagcggtggcacaatctctggaggcgacgaggtaaatgccaagatcaagaacagaaatattcatgggatattaaacgcagtgagttggggaattttgtttccgataggagcaataatagccaggtacatgagagtatttgactcggccgatccggcctggttttacctccacgtttcttgtcaattctctgcttatgtcatcggtgttgccggttgggctaccggacttaagctcggtaacgagtccgagggtattcgcttctccgcccaccgtaacatcggcattgccctcttcacccttgccaccattcagatgtttgcgatgttgttgcggcctaagaaagatcacaagtacagattctattggaatatctaccaccatggagtcggttatgcgatcctcacccttgggatcattaatgtcttcaaaggtctcaacatcttgaaaccacaagacacgtacaagacggcttacattgcagtgattgccgttcttggaggcattgctttgctcttagaagccatcacttgggtcgttgtactcaagagaaaatcaaacaactcaatgaagcctcttaggacctaagccaacaaagatctggtcaacttattaaaggttcatctgcagttgttgttattaatttattatgagctcttgtattattaatgtttatagaacaagggtgtcacatgtattattgttctcttgttttgtagctttttggttttgtttgttgagtatttcttgggttatgaattcttgtaggggatgaatgtttttgaaatagttcttattttactttgaatcaatgagttttttcagttcccaact

SEQ ID NO: 287 - protein, 310 aa, Medicago truncatula
MIGAQALVAIPQASGSPKAYTSNIVDTSTRLQEGTISYPVSGLSATYQNNKVTIFATLTLPNGTTSLVHVWQDGVLSSDSTPQEHSHESSHQNSKEVLDLVSGTSQAASGIGSRQRRRNTHGVLNAISWGILMPTGAVIARYLKVFKSADPAWFYLHITCQVSAYIVGLSGFGTGLKLGSDSEGITYDTHRALAIVLVTLATLQVFALFLRPNKDHKLRFYWNIYHHVVGYVTISISIVNVFKGFEALGDFVGDRYKNWKHAYIGIIGALGGIAVLLEAYTWMVCMKRKKADNKTSDGVNGANGHGSSTL

SEQ ID NO: 288 - DNA, 933 bp, Medicago truncatula
atgatcggagcacaagctttggtggctattccacaagccagtggaagcccaaaagcctatacttcaaacattgtagacacaagcacacggttgcaagaaggaaccattagttatcctgtttctgggttgtctgccacatatcagaataacaaggttactatttttgctactttgacccttccaaatggaacaacctctttggttcatgtatggcaagatggagttctctcttctgattctactcctcaagaacatagccatgaatcttctcaccaaaactctaaggaagtcttggatcttgtttctggtacctcccaagctgcaagtgggattggttcgcgtcaaagaagaagaaatacacatggagtactaaatgctattagttggggaatcttgatgccaacgggagcagtaatagcaaggtatttgaaggtgttcaaatctgcagaccctgcttggttctatcttcacataacttgtcaagtctctgcctacatagttggattatctggttttggtactggtctcaaactcggtagtgattcagagggtattacatacgacactcatagagcacttgctattgttcttgtaaccttggcaactcttcaagtgtttgctctatttttgaggccaaacaaagaccataagttgagattttactggaatatctaccaccacgttgtagggtatgttaccataagcattagcattgtaaacgttttcaaagggtttgaagcgttgggagattttgtaggggatcgttacaagaactggaagcatgcttacattggtattattggtgctttggggggcattgctgtccttttggaagcttacacgtggatggtatgcatgaagaggaagaaagcagataacaagacttcagatggtgttaatggagcaaatggccatggttcttctaccctttaa

SEQ ID NO: 289 - protein, 394 aa, Oryza sativa; identical to SEQ ID NO: 201

SEQ ID NO: 290 - DNA, 1582 bp, Oryza sativa; identical to SEQ ID NO: 202

SEQ ID NO: 291 - protein, 326 aa, Arabidopsis thaliana
MTNGGRGSGGGGGGGGRESGGRDLEIRPGGMLVQKRNPDLDPVGPPPPPMIRVRIKYGAVYHEINISPQASFGELKKMLTGPTGIHHQDQKLMYKDKERDSKAFLDVSGVKDKSKMVLIEDPLSQEKRFLEMRKIAKTEKASKAISDISLEVDRLGGRVSAFEMVTKKGGKIAEKDLVTVIELLMNELIKLDAIVAEGDVKLQRKMQVKRVQNYVETLDALKVKNSMANGQQKQSSTAQRLAPIQEHNNEERQEQKPIQSLMDMPIQYKEKKQEIEEEPRNSGEGPFVLDSSAKWETFDHHPVTPLSSTTAKNNAIPPRFNWEFFD

SEQ ID NO: 292 - DNA, 1202 bp, Arabidopsis thaliana
atgactaatggcggtagaggttccggcggcggtggtggtggcggcggcagggagtcaggcggtcgtgatttggaaattagacctggtggtatgttggttcagaaacgtaacccggatttggatcctgtcggacctccaccaccaccgatgatcagagttagaatcaagtacggtgccgtctaccatgagatcaatattagtcctcaagcttcttttggggagctaaagaagatgttgactggaccaacgggtattcatcatcaagatcagaagctaatgtataaagataaagagagggattcgaaggcgttcctcgatgtttcgggagtgaaagataaatctaagatggtgcttatagaagacccgcttagccaagagaaacggtttttggagatgaggaagattgctaaaaccgaaaaggcgtctaaagcgatatcggatattagccttgaagttgataggctcggcggacgagtttcggcttttgagatggtaactaaaaaaggagggaagattgcggagaaagatcttgtaacggttatcgaattgctgatgaatgagttgattaagttggatgcgattgtagctgaaggagatgtcaagttacaaagaaagatgcaggtgaagagagtgcagaattatgtggaaacactcgatgccttgaaggtgaaaaactccatggctaatgggcaacagaaacagtcaagtactgctcagagacttgcaccgattcaagaacataacaatgaagagagacaagaacagaaaccgatacaatcgctcatggacatgccgatacaatacaaagagaagaagcaagagattgaagaggagcctaggaattcaggggaaggaccatttgtgttagattcttctgctaaatgggaaacattcgatcatcatcccgtgacgccattgagctcgactactgcgaaaaataacgcgatcccgcccaggtttaattgggaattctttgattgagaaagttcacattttgtgaaactttttctttcttttatcttgtatgcttatataattcttgtgtggaagtgttggttttttttcaggcttcttcttcttcttcgtcaccatcattatgattcttttgatgtacttatagatttttgtgtggcgtttgtttatcgttctcgaaaataaacagagacgctacagagaaatgattatgaaaaaacctgtgattc

SEQ ID NO: 293 - protein, 333 aa, Medicago truncatula
MMKMKNVTNHNGGSVPEPRGLEWEMRPGGMLVQRRTLDSDRDSVPPPTIRIKVKFGSTYHEVNISSQATFGELKKMLTGPTGLHHQDQKIFYKNKERDSKAFLDIVGVKDKSKLVVMEDPIAQEKRYLEMRKNIKMERAAKSISEISLEVDRLAGQVSALETIISKGGKVVETDVLSLIEKLMNQLLKLDGIVADGDVKLQRKMQVKRVQKYVETLDMLKIKNSNGGHVPKKKPQQKVKLPPIDEQLEGMSIGNHKLQPSLEQQSQRNSNGNSQVFQQLQHKPSTNSTSEVVVTTKWETFDSLPPLIPVTSASSSSSSTNNSVHPKFKWEHFE

SEQ ID NO: 294 - DNA, 1002 bp, Medicago truncatula
atgatgaagatgaagaacgtgacgaatcataatggaggttcggttcccgaacctagaggcttggagtgggagatgagaccaggagggatgttagttcaacgccgaaccttagactcggatcgagactcggttcctccaccgacaattagaattaaggttaaatttggttccacctatcatgaagtcaacattagttcacaagcaacgtttggtgaattgaagaaaatgttaaccggtccaactgggttacaccaccaagaccaaaaaatattttataaaaacaaggagagggattcaaaggcatttcttgacatagtaggagttaaagataaatcaaagttagtggtgatggaggatcctattgctcaagagaagaggtacttggaaatgagaaagaatataaagatggaaagggctgcaaaatctatttcagaaattagcttggaagtagataggcttgcagggcaggtgtctgctcttgaaacaataattagtaaaggtgggaaagttgtggagacagatgtgcttagtttgattgagaaattgatgaatcaattgcttaagctggatggtatagtggctgatggggatgttaaattgcagaggaaaatgcaggtaaaaagagtacaaaagtatgttgaaactttggatatgttgaaaattaagaattctaatggaggtcatgtcccaaagaagaagcctcaacaaaaagtaaaattgcctccaattgatgagcaactagaaggaatgtctattgggaatcataaattacaaccaagtttggagcaacagtcacaaaggaactcaaacgggaattctcaagtatttcagcagctgcagcacaaaccctctacgaattctacctcagaagttgtagttactacaaaatgggagacatttgattctctaccaccattaattcctgtcacttcagcatcctcatcaagctcatccactaataattcagttcatcccaaattcaaatgggaacacttcgagtaa

SEQ ID NO: 295 - protein, 316 aa, Oryza sativa
MMRGKDQKFPAMKKETAAVAKEEVWEVRPGGMLVQKRSPESEPPPGGAPVPTIRVKVKYNGVYHEIYINSQASFGELKKLLSEKTGLHPDDQKVVYRDKERDSKAFLDIAGVKDRSKMLLLEDPTAQAKRLLEERRHCKAERAAKSVSRVALDVDKLASKVSALEAIVSKGGRVVDADVVALTEALMNELVKLDSIAADGEVKEQRRVQEKRVQKYVEALDAIRAKTKKAAAAPPKARPPHLPPRPPPAQQQQRRQFQPPAPATATAPAPQTATASWESFDLLSSVPSTSSAPVTTMAPATTTTTSPSPRFEWELF

SEQ ID NO: 296 - DNA, 1617 bp, Oryza sativa
cacagccacgctcaccaacccaaaccgacgcgtagtcgacgagttcgatcgattgcccgaccgtatccgtacaattgctgacgcaaccaaaccatcacaaggttaaatacagtaaaagaaaaaataaagaaattctcttcttcttgtagtagaagaagatgatgccattggagttcttggccattgtataaacagggctaagctaggagaaggagccccacacttgtctacttgcaaggtggacaccattggggttgggttgggttgggggttgcttggttgcttgcattgcttagttttcatcagtataaatattctgctgccctgtcccttagttgtaccctgtctttttcttcctcctcataccctttcttcttagctcttcctcccattccttcttcgattcattcctgtctccaattggaggtcacaattgcagcttgcagctagctcaaatttccattttttgtttggttgtctctcggcagcaaagcagatatagagcagaggaaagctaagctaaattagttagttagattactagtctctggcagctgggtgatcttaatttgatcaaagaagaagaagaagaagcaagtttttttagctcctgagtatattataggattaactactactaggatagtactcctatatgagaagaagatgatgcgcgggaaggatcagaaatttccggcgatgaagaaggagacggcggcggtggcgaaggaggaggtgtgggaggtgcggcccggcggcatgctggtgcagaagcggagcccggagtcggagccaccgccgggcggcgcgccggtgccgacgatccgggtgaaggtgaagtacaacggggtgtaccacgagatctacatcaactcgcaggcgtccttcggcgagctgaagaagctcctgtcggagaagacggggctccaccccgacgaccagaaggtggtgtacagggacaaggagagggactccaaggcgttcctcgacatcgccggcgtcaaggaccgctccaagatgctcctcctcgaggaccccaccgcccaggccaagcgcctcctcgaggagcgccgccattgcaaggctgagcgcgccgccaagtccgtctcccgcgtcgccctcgacgtcgacaagctcgcctccaaggtgtcggcgctggaggcgatcgtgagcaagggcgggagggtggttgacgccgacgtggtggcgctcaccgaggcgctgatgaatgagctggtcaagctcgactccatcgccgccgacggcgaggtcaaggagcagcgccgagtgcaggagaagcgggtgcagaagtacgtcgaggccctcgacgccatccgtgccaagaccaagaaagcggcggcggcgccgcccaaggcccggccgccgcacctgccgccgcggccgccgccggcgcagcagcagcagcgccggcagttccagccgccggcgcccgccacggcgaccgcgccggcgccacagaccgcgacggccagctgggagtcgttcgacctgctctcatccgtgccgtccacgtcgtcggccccggtgaccaccatggcgccggcgaccaccaccaccacctcgccgtcgccgaggttcgagtgggagctcttctag

SEQ ID NO: 297 - protein, 308 aa, Populus trichocarpa
MNGGSAGGGGELEVRPGGMLVQKRDPDSDRTSIPPPTIRIKVKYGSTYHEINISSQATFGELKKMLSAPTGLHHQDQKLIYKDKERDSKAFLDISGVKDRSKMVLVEDPISQEKRFLEMRKNAKMEKASKFISEISLEVDRLAGQVSAFESVITKGGKVAEKSVLNLIELLMSQLLKLDGIMVDGDVKLQRKIQVQRVQKYVETLDMLKIKNSMPNASIQKRQPRYTNGHTLIPIEEEEEQRHPFEHLSIHQQQQPSRHSASGEVVVTTQWETFDSTPALEPVPSISTSSTATKTSAPQPKFPWDFFN

SEQ ID NO: 298 - DNA, 927 bp, Populus trichocarpa
atgaatggtggctcagccggtggtggtggtgagttggaggttagaccaggaggaatgttagtacagaagagagacccggattctgatcggacctctatccctccaccgacaattagaatcaaggttaaatatgggtcaacttatcatgaaatcaatattagctcacaggctacatttggggagttgaagaaaatgttgtcagcacccacaggattgcatcaccaagatcagaagctgatttacaaagataaagagagggattcaaaagcatttcttgatatttctggagttaaggacaggtccaaaatggtgctagttgaggacccgattagtcaggagaagaggtttcttgagatgagaaagaatgcaaagatggagaaggcgtcaaaattcatatcagaaatcagcttggaagttgaccggcttgccggccaggtttcagcttttgaatcagtaattactaaaggtgggaaagtagcagagaaaagtgtgcttaatttgatcgagttattgatgagtcaattgttgaaattggatggaattatggttgatggcgatgtcaaattgcaaaggaaaatacaggttcaaagggtgcaaaagtatgttgagactctcgatatgttgaagatcaagaattccatgcctaatgcctcaattcaaaagcggcaaccaaggtataccaatggacacacattaataccaatcgaagaagaagaagaacagcggcacccattcgagcatttatcaatccatcaacaacagcagccatcaaggcattcagcatcaggggaagttgttgtaaccacgcaatgggaaacatttgattctactccagctttagagccggtcccttcaatatctacatcctccacagcgaccaaaacttcagcccctcagccgaagttcccttgggatttcttcaactaa

SEQ ID NO: 299 - protein, 329 aa, Sorghum bicolor
MMRGNREQRVAFSPMKESAAAAVPKEEVWEVRPGGMLVQKRSPDTDPPPGGAPVPTIRVKVKFNGVYHEIYINSQASFGELKKLLSEKTGLHPDDQKVVYKDKERDSKAFLDMAGVKDRSKMVMLEDPAAKAKRLLEERRTSKAERAAKAIARVALDVDKLATKVSALETIVSKGGKVVDADVVTLTEALMTELVKLDAVAAVDEEVKVARRAQEKRVQKYVETLDAVRAKNKAAPVSKATNNNTNNKARPPHLPPRPPPAAAHQNHQRRQFQPPAPTTATALVPQTQTASWETFDLLSSVPSTSAAPVTSMAPATTTTPSPRFEWELF

SEQ ID NO: 300 - DNA, 1909 bp, Sorghum bicolor
tcctttacctctcctgctcctcctccccatcttcttcttcttcttcttccttcgttcgttcgtttctccatttgaagcttaccggcatctgctcctagtctagtgaccaacctcccctcccctccaccggccaagaactgatttttccggttccggtgcagcagaagattgcagtagtagtagcagcagctaacttgccagcagaagattttttctgagcttggttcttgatcgatcggccgctcgactgctccagacagtgtacatacatacgcacatactctgctcgtctgccgaggatccatcgctccgcctcggtgctgcatagatagataggtaggtagagatatacagctagaagaggccgggaaccagaggaggaggcctcgctcgatctccaagaacagcagtaagatcaacaagatgatgcgcgggaaccgggagcagagagtggccttctcgccgatgaaggagtccgccgccgccgcggtgcccaaggaagaggtgtgggaggtccggcccggcgggatgctggtgcagaagcggagccccgacacggacccgccccccggcggcgcgcccgtgcccaccatccgcgtcaaggtcaagttcaacggcgtctaccacgagatctacatcaactcccaggcatccttcggcgagctcaagaagctgctgtcggagaagacgggcctgcacccggacgaccagaaggtggtgtacaaggacaaggagagggactccaaggcgttcctggacatggccggcgtcaaggaccgctccaagatggtcatgctcgaggaccccgccgctaaggccaagcgcctcctcgaggagcgccggaccagcaaggccgagcgcgccgccaaggccatcgcacgcgtcgcgctcgacgtcgacaagctcgccaccaaggtgtcggcgctggagacgatcgtgagcaagggcggcaaggtggtggacgcggacgtggtgacgctgaccgaggcgctgatgaccgagctggtgaagctggacgccgtcgccgctgttgacgaggaggtgaaggtggcgcggcgggcgcaggagaagcgggtgcagaagtacgtggagacgctggacgccgtccgcgccaagaacaaggcggcgccggtgtccaaggccaccaacaacaacaccaacaacaaggcacggccgccgcacctgccgccgcgcccgcccccggcggcggcgcatcagaaccaccagcggcggcagttccagccgccggcgcccaccacggcgacggcgctagtgccgcagacgcagacggcgagctgggagacgttcgaccttctgtcgtcggtgccgtcgacgtcggcggcccccgtgacgagcatggcccccgccaccaccaccacgccgtccccgcgcttcgagtgggagctcttctagaaggctccacgcgccagccagcctgcctgcctgcctgtgccccccctggccccggccctcctctcccgccacatgtgtgcctgcctgtccattggctcggccggtacctttcttgttcaccttgcttgcctatggtgcatgtcaatcgccattgtttctttctttctttctttctttctttccccggtctctttattctttctttcctcctgtccttcctttgagtaaattgagtctgtgtatattgcatgatctccacccaaaaaagaaaggcaacaaaacaactgcagtgagctcctagtgaacagagcagaaacgcatgctgcatccatggtgtggtgtctgtctgcaaataagtggtggccttgcattgcaaccgatcgaaccgatgaaggatttttgtgctcccgtattgtatagtagtggcagcagtgtatgtatagtgtacatgaatgaatgaatcaaacaaagctctcaatcatacgtatttgtttgc

SEQ ID NO: 301 - protein, 170 aa, Arabidopsis thaliana
MGFPVGYTEVFLPKLFVQTLSILGFIRTIVFSIFRFLGLSDFLEMDQTWPDYTSYPTRIPETRSPFSALLIREILPVIKFEELTNSGEDLPENCAVCLYEFEGEQEIRWLRNCRHIFHRSCLDRWMDHDQKTCPLCRTPFVPDEMQEEFNQRLWAASGVHDFHCPVTELL

SEQ ID NO: 302 - DNA, 774 bp, Arabidopsis thaliana
aactttttcaaaaaaaggaaaaaaaacagagctcactcattattatctctctaaaaaccctagctttctccatgggctttcccgtaggttacacagaggttttcttaccgaagcttttcgtacaaacgctttcgattctcggattcatcagaaccatcgtcttctctatcttccgcttcttgggtctctcagattttctcgaaatggatcaaacctggcccgattacacatcgtacccgacccgaatacccgaaacccgctcacctttctccgcactcctaattagagagatcctaccggttatcaaattcgaagagttaacgaattccggcgaagatctaccggaaaactgcgccgtttgtctatacgaattcgaaggagaacaagagatccggtggctgagaaattgcagacatatatttcaccggagctgtcttgaccgttggatggatcatgatcagaagacgtgtccactttgtagaacaccgtttgttccagatgagatgcaagaagagtttaatcaacggctatgggctgcttctggtgttcatgattttcactgtcccgtgaccgaattattatagaagaagccacgcttttctatctttttctgtgtcccttatgttcttttttgttttgactttcacccctctacttttgatgttgcttttttcacccctcttactgacatttagacttgccacgcttttatgtgtgtatatactccttacatatgaatgagagatgagcaataaatattaccgagacaggaaa

SEQ ID NO: 303 - protein, 162 aa, Oryza sativa
MSFPLVCFCRQIPRPIVALFKLLQAVALAFVLILCFLGLYEFPYTVEDHAPLIHGRRRDPLGDDGLQPEAVKRGLPLVEYMQLADLSADCHDGESGYPATCRVCLERLEATDEVRRLGNCTHAFHIGCIDRWIDLGEVTCPLCRSHLLPRQRRGLLGSRRFG

SEQ ID NO: 304 - DNA, 1249 bp, Oryza sativa
tttcgccctctaaaaccagacactgctgctgcgtgtctgtgtgccgcgccacctatgcacctcgcgcgcgcggcaagcgctcctcctgccggcgccttcccctgtccctcgcttgcctccagctgcagcagaggagcgcgtgtgcgtgtgtgtacggtgccatgagctttccgctggtgtgcttctgccgccagatcccgcggcccatcgtcgcgctgttcaagctgctccaggccgtggcgctggccttcgtgctgatactctgcttcctcggcctctacgagttcccctacaccgtcgaggaccacgcgccgctcatccacggccgccgccgcgatcccctcggcgacgacggcctgcagcccgaggcggtgaagcggggcctcccgctggtcgagtacatgcaactcgccgacctgtcggcggattgccacgacggcgagagcggctacccggccacgtgcagggtgtgcctggagaggttggaggcgacggacgaggtgaggcggctgggcaactgcacccacgccttccacatcggctgcatcgaccggtggatcgacctgggagaggtgacgtgcccgctctgtcggtcccacctgctgccacgtcaacgaaggggcctgcttggcagtaggcggttcggctagattgtctcgcggcacggcgccatgggggcagtttcgtcatttcaggctgtacatctcgccattgttgctggatgggtgcaggccaaccgcagactgattccgatcaggacgactaaccaccaagcagtaccggtgctaatcaattgatagttgtgctcacgcgaaaattaatggcattttggaattccacgggtgtactttaacgcatagttgcatccgacgagctaggtaacgtgcacccgtttagagcgagtacaatggcaggctacaagtaagctataagcatacgtggaagagagaagagataagagagaaggaaaacaggctatatatttacagccagcttcagcacggaatctaatacattgtgcgtgtatgagatgtaggatcatatattaatagtgtactactccctccatttcacaatataagtcattctagcatttttcgcattcatattgatgttaatgaatataaatgtggaaaatgttagaatgatttacattgtgaaacggagaaagtatatgtttatagataactattgtataaatgaactattagattatctataaataaattggagctagtagttggctatt

SEQ ID NO: 305 - protein, 159 aa, Sorghum bicolor
MTFPLVCYCNAVPRPVAALFKLLHAVALVFVLVLCFLGLYEFPYDPEDHAPVINGPPRRPRGDAPRPEAVKQRLPLVEFLELSSSSSSSGAAEPTCRVCLERLEATDEVRRLGNCTHAFHTRCIDRWIDLGEVTCPLCRSHLLPRRRAGILGMGMARLG

SEQ ID NO: 306 - DNA, 988 bp, Sorghum bicolor
gccaaagccaaaactacacagacgcgcatgcacgcggcgccggtcagatcatgaccttcccgctggtctgctactgcaacgcggtgccgcgccccgtggccgcgctgttcaagctcctccacgccgtggcgctggtgttcgtgctggtgctctgcttcctcggcctctacgagttcccctacgaccccgaggaccacgcgccggtcatcaacggcccgccccgccgcccgcgtggggacgccccgaggccggaggcggtgaagcagcgcctcccgctcgtcgagttcctggagctgtcgtcgtcatcgtcgtcgtcgggggcggcggagccgacgtgccgggtgtgcctggagaggctggaggcgacggacgaggtgcggcggctgggcaactgcacccacgcgttccacacgcgctgcatcgaccgctggatcgacctgggcgaggtgacgtgcccgctgtgccgctcccacctgctgccgcgtcgacgcgccggcatacttggcatgggcatggcacgcctcggctagtcgtccgtccgtgttcgtccctgattcattctcttgccacgtaagatacgtgcccgcgtggttggcttcaggccgcgcggccggtacgcgtacagatgccactggtgccggataggggcggaccaaccgcgaactgattgcgcgcgattaggacgacgatcgactaaccaccaccctgatgttgttgtgtcgatggatgggcgcaagacaaattaactggaggttggcataaagcatacttgacgcgatatattattgtgtgccggcgttggacgggcaacgctcttgtattattatatatcagaagaaaatcaagttacaaactgttttggcttcggggcgcaaccgtgcaaatgatgtccacgccggccagtaatttggtgcctgctctggtgtgtggagcgttcagcttcagagtattgtttaaatcattatttggaaaatcattcaaataaaaa

SEQ ID NO: 307 - protein, 364 aa, Medicago truncatula
MNTFSHVPPGFRFHPTDEELVDYYLRKKVSSKKIDLDVIKDVDLYKIEPWDLQELCKIGSDEQNDWYFFSHKDKKYPTGTRTNRATKAGFWKATGRDKAIYSKQFLVGMRKTLVFYKGRAPNGQKSDWIMHEYRLETNQNGISQEEGWVVCRVFKKRMTTVQKMNEYDQSPCNWYDDQVSFMPDLESPTRTNSHPPNYTSYHSCKPELELIQYNTPHQYHDANFLQLPHLESPKITQSIIPYNHHAHANNNNIALTQQMQYLQYHQQNLHSLYGGNSSTGNDEQVTDWRVLDKFVASQLSHEDNDNNNNNQDHVSNKETSSFSNAAILHVAEQITLLDNGSKKNEVSEEHASTSTSSCHMELWK

SEQ ID NO: 308 - DNA, 1095 bp, Medicago truncatula
atgaatacattttcacatgtacctccaggctttcgttttcatccaaccgacgaagaacttgttgattactacctcaggaagaaggtatcgtctaaaaagattgatctcgatgtcatcaaagacgttgatctctataaaattgaaccatgggatcttcaagaattatgcaaaataggaagtgatgaacaaaatgactggtatttctttagtcataaagataagaagtatccaacaggaactcgaacgaatagagcaacaaaagcaggattctggaaagccacaggaagagataaggcaatatactcaaaacaatttctggttgggatgagaaagactctagtgttttacaaaggacgtgccccaaatggacagaaatctgattggatcatgcatgagtaccgtcttgaaactaatcaaaatggaatttctcaggaagaaggatgggttgtatgcagagtattcaagaagagaatgacaacagtgcaaaaaatgaatgagtatgatcaatcaccatgtaactggtatgatgatcaagtttccttcatgccagatcttgaatctccaacccgaaccaattctcaccctcctaactatacttcatatcactcatgcaaaccagaactagaattaattcaatataacacaccccaccaataccatgatgctaattttctccaacttccacaccttgaaagtccaaaaattactcaatctattatcccttataatcatcatgctcatgcaaacaataacaatattgcacttactcaacagatgcaatatttgcagtaccatcaacaaaatcttcactcactttatggtggtaacagcagtactggcaatgatgaacaagttactgattggagagtgcttgacaagtttgttgcttctcagctaagtcatgaagataatgataataataataataatcaagatcatgtttctaataaagaaactagttctttctccaatgcagctattcttcatgtggctgaacaaattactcttcttgataatggatccaaaaagaatgaagtttctgaggaacatgcttcaacttctacctccagttgccacatggaactttggaagtga

SEQ ID NO: 309 - protein, 344 aa, Medicago truncatula
MMQGSGELTVPPGFRFHPTDEELLYYYLRKKVSYEAIDLDVIREVDLNRLEPWDLKDKCRIGSGPQNEWYFFSHKDKKYPTGTRTNRATTAGFWKATGRDKAIYHTNSKRIGMRKTLVFYTGRAPHGHKTDWIMHEYRLDDDDNAEVQEDGWVVCRVFKKKNTNRSYQQEIEEEDHHMINHMRSTNGPNHFLEPKHHHHMQQLGLYDYNNNTTTTFDGTIHLPQLFSPESAIAAPPTSFHNSSMDILECSQNLLRLTTTNTSSGLNLMQQQQQQGERLISGSDWSFLDKLLASHNGMDLNLRNKLCNTPNNHQAAPSAVGTSSAQKFPFHYLGCESHDIMKFSK

SEQ ID NO: 310 - DNA, 1035 bp, Medicago truncatula
atgatgcaaggaagtggagaattaacagttcctccagggtttaggttccacccaactgatgaggagcttctttactattacttgaggaagaaagtttcttatgaagccatcgatcttgatgttatcagagaagttgatctcaacagacttgagccttgggatctcaaagataagtgtaggattggatcagggccacaaaatgagtggtatttcttcagtcacaaggacaagaaatacccaacaggaacaagaacaaatagagcaactacagctgggttttggaaagcaacaggaagagacaaagccatatatcacaccaattccaaaaggattggaatgaggaaaaccttagtgttctacactggacgtgctcctcatggtcacaaaactgattggatcatgcatgagtatcgtcttgatgatgatgataatgcagaagttcaggaagatggatgggtagtttgcagggtattcaaaaagaaaaacacaaacagaagctaccaacaagaaattgaagaagaagatcatcacatgattaaccacatgagatcaacaaatggtccaaatcattttctagaaccaaaacatcatcatcacatgcaacaactaggactatatgattacaacaataacaccaccaccacctttgatggtacaattcatctaccacaattgttcagtccagaatcagccatagcagcaccacctacttccttccataattcatcaatggacatccttgaatgctctcaaaatttgttgaggctcacaacaacaaatactagctctggacttaatctcatgcaacaacaacaacaacaaggagaaaggttgatcagtggtagtgattggtcattcttggataaactacttgcatcacacaatggaatggatcttaatctaaggaacaaattatgtaacactcctaataatcaccaggctgcaccttctgctgttggaacttcttctgctcagaaatttccatttcattaccttggttgtgagtctcatgatattatgaaattttcaaagtaa

SEQ ID NO: 311 - protein, 400 aa, Oryza sativa
MSISVNGQSCVPPGFRFHPTEEELLNYYLRKKVASEQIDLDVIRDVDLNKLEPWDIQERCKIGSGPQNDWYFFSHKDKKYPTGTRTNRATAAGFWKATGRDKAIYNAVHRIGMRKTLVFYKGRAPHGQKSDWIMHEYRLDDPATDTAAATPTVTSAAAAAAAMAAAADGGQEDGWVVCRVFKKKHHHKEAGGGGGKHGGDGSAGAKAAHAYSSSDDALDQILQYMGRSCKQEHELPSPQASGGGGAGAGSRPASRYLRPIDTVLGGHGFMKLPPLESPSAATALSSTPSTGGDAASSAAAAAADHLLLHHHHRTDWAMMDRLVASHLNGANSDAPDDQLCFDAADDDGLAYYSAAATRLLGGANAGTDDDLWSFARSAAPPPPPPPPSSATPERLSHVAL

SEQ ID NO: 312 - DNA, 1979 bp, Oryza sativa
gtccatccttctcccaatcaagcatccatccatcctccccaactatatataaaccccacacctttccctcgccaccgccctcgatcgtcttcttcctcctcctctcaatctcttcttccttctcctgcagccgccatttctagctagctatacgatcgatctatacatatatatcagaaggaaggaagaggctaattaagctagctgttgctagagctagcaagagcgaggagattgagcagctaggtaggtagcaagaaggagaagaagaagaagatcatcaatgagcatctcggtgaacgggcagtcgtgcgtgccgccggggttccggttccacccgacggaggaggagctgctcaactactacctccgcaagaaggtcgcctccgagcagatcgacctcgacgtcatccgcgacgtcgacctcaacaagctcgagccatgggacatccaagagaggtgtaagattgggtcagggccgcagaacgactggtacttcttcagccacaaggacaagaagtacccgacggggacgaggacgaacagggcgacggcggccgggttctggaaggccaccggccgcgacaaggccatctacaacgccgtccaccgcattggcatgcgcaagacgctcgtcttctacaagggccgcgccccccacggccagaagtccgactggatcatgcacgagtaccgcctcgacgaccccgccaccgacaccgccgccgccacacccacggttacttctgctgctgctgcggcggcggcgatggcggcggcggcggacggcgggcaggaggatggctgggtggtgtgcagggtgttcaagaagaagcaccaccacaaggaggccggcggcggcggcggcaagcacggcggcgacggcagcgccggcgccaaggcggcgcacgcttactcctccagcgacgacgcgctcgaccagatcctgcagtacatgggcaggtcgtgcaagcaggagcacgagctcccctcgccgcaggccagcggcggcggcggcgccggcgcagggagcaggccggcgtcgaggtacctccggccaatcgacaccgtgctcggcggccatggcttcatgaagctgccgccgctcgagagcccgtcggccgccacggcgctctcctccactccgagcaccggcggcgacgcggcctcctcggccgccgccgccgccgccgaccacctgctgctccaccaccaccaccgcacggactgggccatgatggaccgcctcgtcgcgtcgcacctcaacggcgccaactccgacgcgcccgacgaccagctctgcttcgacgccgccgacgacgacggcctcgcctactactccgccgccgccacgaggctgctcggcggtgccaacgccggcaccgacgacgacctgtggagcttcgcgcggtcggctgcgccgccaccgccgccgccgccgccgtcgtcggccacgccagagcgtctcagccacgtggcactgtaacacatgattcgtagctgtacgtacacgtacacgtatacgtacacgtcaggctacgtacgctcgagctgccaccctagctgctagtacagtaattacagagacaagacaagtaagaagaaaattgtaagtgaaaaaaaaaataaaagcaagagagagagagagagagagatccaccatgaatgatactgatagagagacatcattcgatcgatatatttcaaaggtgattagcaaagatcgagtgattaattaattagtgagtgagacactgagaaaagaaagaaagaaaagaaagaaaaattaaggagccaaaagagaggaggagaaaaaagaagaagaagagagattaaaggcaaagcgagtagtaagttagggtggcactgtcaaacatgtctgcatccaatgtttaattaattaattaaccctactacctgtccaggacagaaaaatatatattagcatctcattacttataatatactccctccgtttt

SEQ ID NO: 313 - protein, 451 aa, Arabidopsis thaliana
MTTALFSPSNRRKRRLTHFFFTVLAFILLAAFIYGHDFISFSRRSLHSPTIVHQSAIVVVVDEPPPPPPTSPPPPSPPPPSPPPPSPPPPSPPPPAFAVGKTPEGCDVFKGNWVKDWSTRPLYRESECPYIQPQLTCRTHGRPDSDYQSWRWRPDSCSLPSFNATVMLESLRGKKMMFVGDSLNRGMYVSLICLLHSQIPENSKSMDTFGSLTVFSLKDYNATIEFYWAPFLLESNSDNATVHRVSDRIVRKGSINKHGRHWRGADIVVFNTYLWWRTGFKMKILEGSFKDEKKRIVEMESEDAYRMALKTMVKWVKKNMDPLKTRVFFATMSPTHYKGEDWGGEQGKNCYNQTTPIQDMNHWPSDCSKTLMKVIGEELDQRAEFPVTVLNITQLSGYRKDAHTSIYKKQWSPLTKEQLANPASYSDCIHWCLPGLQDTWNELFFAKLFYP

SEQ ID NO: 314 - DNA, 1509 bp, Arabidopsis thaliana
actacaccataaaaagagaaaggcgtaaaaaggaaaaagaaaaaaaaaggtaaacgttataataaaagaaaaaaaaaaatatgacaacggcgttgttttcaccgtctaaccgtagaaaacgccgtctcacacacttcttcttcaccgtactcgctttcatcttactcgccgccttcatctacggccacgatttcatctctttctctcgtcgatctcttcactctccgacgatcgtccaccaatccgcaatcgtcgttgtagttgacgaacctcctccgcctccaccaacatctcctcctccgccttctcctccaccaccgtctcctccaccaccatctcctccaccgccatctcctccgccacctgcttttgcagtaggtaaaacgccggaaggatgcgatgtcttcaaagggaattgggtcaaagactggtcaacgcgtccactttacagagaatccgagtgtccgtacattcagccgcagctcacttgccgcacgcatggccgtcccgatagtgattatcagtcatggagatggcgacctgattcctgctcacttccttcgtttaatgcgacggtgatgttggagagcttaagagggaagaagatgatgttcgttggagattcgttgaacagaggaatgtatgtttctctcatctgtcttcttcattcacaaatcccagagaactccaaatccatggatactttcggatcactcaccgtcttctctctcaaggattacaatgcaacgattgagttctattgggcaccgtttcttctagaatcgaattcagataacgcaacagttcatagagtatcagatcgaattgtgaggaaaggatcgatcaacaaacacggtaggcattggcgaggggctgatatagttgtgttcaacacatacttgtggtggaggactggcttcaaaatgaagatcttggaaggttctttcaaggatgagaagaagagaatcgttgagatggagagtgaagatgcttatagaatggcgttgaagactatggttaaatgggtgaagaagaatatggatccattgaagacgagggttttctttgctaccatgtctcctactcattacaagggcgaggattggggaggcgaacaaggaaaaaattgttacaatcaaacgacaccgatccaagacatgaaccattggccatcagactgcagcaaaaccttaatgaaagtgataggagaggaattagaccaaagagcagagtttccggtgacggtacttaacattacacaactctctggctatcggaaagacgcgcacacgtcaatctacaagaagcaatggagcccattgacgaaggagcagctagcaaatccggctagctactcagactgtatacattggtgcttgcctggtcttcaagatacttggaacgagcttttctttgccaagttattttatccatgattcttttctctaaattcaagatttttttagaactgtaattgtaaattatggttataatttttgttaattacgt

SEQ ID NO: 315 - protein, 433 aa, Medicago truncatula
MANSFNPSSLLLKTKPRLSSYLFTLLSIILFTAIILNTHDFLFIFRPHLQQLHPKTETNTVLFSTVTQSNNTVQEVEKKEEEEEEEKECDLFSGTWVKDELTRPLYEESECPYIQPQLTCQEHGRPDKEYRRLRWQPHGCDLPKFNASLMLETLRGKRMMFVGDSLNRGQYVSLICLLHHLIPQHAKSMETFDSLTVFTAKEYNATIEFYWAPFLLESNSDNAVIHRVTDRIVRKGSINKHGRYWKGADILVFNTYLWWVTGSNMKILLGSFKDEVKEIVEMQTEEAYRMAMKSMLRWVKMNMDPNKTRVFFTSMSPSHGKSIEWGGEPGGNCYNETTPIEEPSYWGSDSLKSIMQVIGEEFRKSKFPITFLNITQLSNYRKDAHTSIYKKQWNPLTPEQLANPASYSDCIHWCLPGLQDTWNELLFAKLFYP

SEQ ID NO: 316 - DNA, 1302 bp, Medicago truncatula
atggcaaactcattcaacccttcttctcttcttctcaaaacaaagcctcgtctctcttcttatctcttcaccctcttatccatcatcctcttcaccgccatcatcctcaacacccatgacttcctcttcatcttccgtccacatctccaacagctccaccccaaaactgaaaccaacactgtactcttttcaacggtgactcagtccaacaacaccgttcaagaggtggagaaaaaggaagaagaagaagaagaagaaaaagagtgtgatttgtttagtggaacgtgggtgaaagatgagttgacacggccattatatgaagaatctgagtgtccgtatatacaaccacagttgacttgtcaagaacatggccggccggataaagagtaccgccggttgcggtggcagcctcacggttgcgatcttcccaaattcaatgccagcttaatgctagaaacacttcgtgggaagaggatgatgtttgtcggggactctctcaatcggggtcagtatgtctctttgatatgtcttctccatcatctcattccccaacatgccaaatcgatggaaacctttgattctctcactgtcttcacagccaaggaatacaatgctacaattgagttctattgggcaccttttcttcttgaatcaaactccgataatgctgtcatccatagggtaactgatagaattgtaagaaagggttcaatcaataagcacggtcgttattggaaaggcgcagacattttggtattcaacacctatctttggtgggtaaccggctccaacatgaagatattgcttggttcttttaaggatgaagtaaaagagattgttgagatgcaaacagaggaagcctatcgcatggctatgaaaagtatgcttagatgggtgaaaatgaacatggatcccaacaagactagagtcttcttcaccagcatgtcgccttctcatggaaagagcatagagtggggaggggaaccaggagggaactgctacaatgaaacaactccaattgaagaaccctcatattggggatctgattcattgaaaagcataatgcaagtaattggagaagagttcagaaaatcaaaatttcccataacatttctcaatatcactcaactttccaactaccgtaaagacgcacatacatcaatctacaaaaagcaatggaatccattgactccagaacaactagctaaccctgctagctactctgattgtatacactggtgtttacctggacttcaagatacttggaacgagcttctatttgccaagttattttatccttga

SEQ ID NO: 317 - protein, 393 aa, Oryza sativa
MHQPAIMQRALAVVALLAAAAAIAAAQGESPELLPFAVGAAPEGCDVGEGEWVFDEAARPWYAEEECPYIQPDLTCQAHGRPDAAYQRWRWQPRDCSLPSFNATGMLEMLRGKRMLFVGDSLLRGQYTSLLCLLHRGAPGGGGGSRSFETVDSLSIFRAKDYDATIEFYWAPMLAESNSDGAAVPDDRLIRGAPMNKHSSFWKGADVLVFNSYLWWMTGDKIQILRGADEDMSKDIVEMEAAEAYRLVLHQVTRWLEGNVDPKSARVFFVTASPSHAGAGGECYDQTTPVGAADAASYCGSTSRRMVQVAGEVLGASRVPVGVVNVTRMSELRRDAHTQVYREQRWAKPTAEQLAADPRSYADCTHWCLPGVPDAWNELLYWKLFFPARDEAI

SEQ ID NO: 318 - DNA, 1701 bp, Oryza sativa
ccttcactagccttctctaccaccctcactcgcgagctcggctcagctcagctcacctcgcacccagatcccaatgcaccaaccagccataatgcagcgggctctcgccgtcgtcgccctcctcgccgccgcagccgccatcgccgccgcccagggggagtcgccggagttgctgccgttcgcggtgggggcggcgccggaggggtgcgacgtcggggaaggggagtgggtgttcgacgaggcggcgcggccgtggtacgccgaggaggagtgcccctacatccagcccgacctcacctgccaggctcacggccgccccgacgccgcctaccagcgctggcgctggcagccgcgcgactgctccctcccaagcttcaacgcgacggggatgctggagatgctgcgggggaagcggatgctgttcgtcggggactcgctgctccgggggcagtacacgtcgctgctctgcctcctccaccgcggcgctcccggcggcggcggcgggtccagatccttcgagacggtggattcgctcagtatcttcagggccaaggactacgacgccaccatcgagttctactgggcgcccatgctcgccgagtccaactccgacggcgccgccgtccccgacgaccgcctcatccgcggcgcccccatgaacaagcactcctccttctggaagggcgccgacgtcctcgtcttcaactcctacctctggtggatgaccggcgacaagatccagatcctgagaggcgcggacgaggacatgagcaaggacatcgtggagatggaggcggcggaggcgtacaggctggtgctgcaccaggtgacgcggtggctggagggcaacgtggaccccaagagcgcgcgggtgttcttcgtcacggcgtcgccgtcgcacgccggcgccggcggcgagtgctacgaccagacgacgccggtgggcgcggccgacgcggcgtcgtactgcgggagcacgagccggcggatggtgcaggtcgccggcgaggtgctgggggcatcgcgggtgcccgtcggggtggtgaacgtcacccggatgtcggagctccgccgcgacgcgcacacgcaggtgtacagggagcagcggtgggcgaagccgacggcggagcagctcgccgccgacccgaggagctacgccgactgcacccactggtgcctccccggcgtccccgacgcgtggaacgagctgctctactggaagctcttcttccccgcgcgcgacgaggcgatctgacctcatgacgtcacgccgccgccatcgtcgtcgtcgtcgtcgtcactaatcggtgtaatctgctccgttcccgccatttcttttcttggcgatcgatgtaatcaaatctctctatacttgctcctcttctctcctcttctctttttgaacgaagtgaaaatacagaagctagcattatttgcttgcatgtgtacaaaatccacgatcttgcatcaagattaactaatgtgatcaccaattcaggatcactctgttgagcaagaacctggagttgcacagatgtttttggatctcacatccagaattggaggttgccttttgatgggccgaaattacaaaaacaaggcgggcttatgaggcccaattatagagattatttgggccataacgagaggggtcggaaactaaaaatccgaatccctaataaacgaggtcaattttcttcg

SEQ ID NO: 319 - protein, 441 aa, Oryza sativa
MMKPQHGGMAGHGGGRTRSPFLTSYALTLAFITFVSVLYFKDFSSTLHQPFLTRPPPHRRQIARPRAPSHHHGGGSSSGGGDVVPPFAVGAAAAAGCDVGVGEWVYDEAARPWYEEEECPYIQPQLTCQAHGRPDTAYQHWRWQPRGCSLPSFNATLMLEMLRGKRMMFVGDSLNRGQYVSLVCLLHRSIPESSKSMETFDSLTVFRAKNYNATIEFYWAPFLAESNSDDAVVHRIADRIVRGTALEKHARFWKGADILVFNSYLWWMTGQKMKILQGSFEDKSKDIVEMETEEAYGMVLNAVVRWVENNMNPRNSRVFFVTMSPTHTRSKDWGDDSDGNCYNQTTPIRDLSYWGPGTSKGLMRVIGEVFSTSKVPVGIVNITQLSEYRKDAHTQIYKKQWNPLTPEQIANPKSYADCTHWCLPGLQDTWNELLYSKLFFP

SEQ ID NO: 320 - DNA, 2311 bp, Oryza sativa
actactttgaggttttcagctggagccacccacctctgcacttctctacccactaccagtaaccagtagtcggccacgccattcaaccattttcaagcctactccaccaaagtgcaagaaagggggaggccccatcaccaaaagccactcctctcctctcattgcagactgcagagccaagaacacatccatcttctccttctcccattgctccagatcccatcagatcctcaccgagatcatcagatcagagcaagaggaggtagctcgatgcgcggggcggcggcggcggggaggagatgatgaagccgcagcacggcggcatggcggggcatggaggaggaaggacgaggagccccttcctgacgtcgtacgcgctcacgctcgccttcatcaccttcgtctccgtcctctacttcaaggacttctcctccacgctccaccaacccttcctcacccgccctcctccccaccgccgccagatcgcccgcccccgcgccccgagccaccaccatggcggcggcagcagctccggtggcggcgatgtggtgccgccgttcgcggtgggggcggcggcggcggcggggtgcgacgtcggggtgggggagtgggtgtacgacgaggcggcgcggccgtggtacgaggaggaggagtgcccctacatccagccgcagctgacgtgccaggcgcacggccgccccgacacggcgtaccagcactggcggtggcagccgcgcggctgctcgctccccagctttaatgcaactcttatgttggagatgctgcgggggaagcgcatgatgtttgttggagattctctgaaccgtggacagtatgtgtcattggtgtgcctcctacaccggtccatccctgagagctcaaagtccatggaaacttttgactcgcttacggttttcagagcaaagaactataatgccaccattgagttctactgggctccctttctagctgaatcaaattctgatgatgctgttgttcaccgtattgcggatagaattgtaagggggacagcccttgaaaagcatgccaggttttggaagggagctgacatcttggtattcaacagctacctttggtggatgactggacaaaagatgaaaattctgcaaggttcttttgaagataagagtaaggatattgtagaaatggaaacagaggaagcctatgggatggtactgaatgcggtcgtgaggtgggtggagaacaacatgaaccccagaaattcaagggtctttttcgtcacaatgtcacccactcataccaggagcaaagattggggtgatgattcggatggaaattgctacaaccaaactactccgatcagagatttgtcatactggggtccaggaactagcaagggcttgatgcgcgtcattggagaagtgttcagcacatctaaggtccctgtggggatcgtcaacatcacccagctttccgagtaccgcaaagatgctcacactcagatatacaagaagcagtggaacccgctaaccccggagcagatcgcgaacccgaagagctacgcggattgcacgcattggtgcctcccaggtctccaggacacatggaatgagctgctctactccaagctgttctttccttgagcaaaagaacagtttctgatatttgagtttggagcactgatccctatgtctgaactctgaagagaattttgctgaatgccacgtccaagttgtgagtatatcagatcacctggggagtttctgaccttctggaggagagtcagtcagtctaacatcatataggtccaaacattctgaagattacgattgaatcataaatatacaaggagcactagatggaaatatcatggaaaatgctgagctcgttgaaaagccacatgctcatactgtactaatcacatggctgttgattttgttggacatgaatatcgaggcgacaatattcttgcagtcgcatggagaatattatgtggcctttccgagttaatggaagctaatcacatgctgttgattttgctgcacattcttttttgagtaaaatgcaccggcagtccttaaacttgtcaggaggtttcacttagatccacaaacttgcaaagcatacatcaaggttcttaaacttggtttattgtatcatcccggtccaaagccgcgtttgaccatggtcttacctacgtaacacgctatgtggatgatgacatggaatctttttatttttttctcccttctttttttttctctttcttccttgtcgaaaagacgaaaatgccttgtacatgtcatcgtccatgtcatcgtattttcat

SEQ ID NO: 321 - protein, 410 aa, Populust trichocarpa
MKQPFTASSSSSSLIRKARLSPYLFTLLAFIVFVAILYGEDFVCLLGQLDPNLPFSIGKAPDGCDLFSGRWVWDDSTRPLYEESECPYIQPQLTCQEHGRPDKDYQYWRWQPYGCDLPSFNATLMLETLRGKRMMFVGDSLNRGQYVSMVCLLHRLIPEGQKSMETFDSLTVFTAKEYNATIEFYWAPFLLESNSDNAIVHRISDRIVRKGSINKHGKNWKGVDIIVFNTYLWWMTGLKMKLMFFRHGSFEDETKDIIELSTEDAYRMAMKSMLRWVRKNMDRKKTRVFFTSMSPSHGKSIDWGGEAGLNCFNETTLINNATYWGSDCRKSIMGVIGDVFRKSKFPITFLNITQLSNYRKDAHTSIHKKQWNPLTPEQIANPVSYADCVHWCLPGLQDTWNELLFAKLFY

SEQ ID NO: 322 - DNA, 1230 bp, Populus trichocarpa
atgaagcaaccgttcactgcttcctcttcttcttcatctctaatcagaaaggcccgtctctctccttacctcttcactttattagccttcattgtctttgttgccatcctttatggcgaggacttcgtgtgcctccttggccaacttgaccccaacctacctttctcaatagggaaggccccagatggttgtgacttgtttagtgggaggtgggtgtgggacgattcaactcggcctctttacgaagaatcggagtgtccgtacatacagccacagttgacatgtcaagagcatggcaggcctgataaggattatcaatactggagatggcaaccttatggctgtgatcttcccagttttaatgccacgttgatgcttgagaccttacgaggaaaaagaatgatgtttgttggcgattccttaaatcgaggtcaatatgtctccatggtctgtcttcttcacagactaatccctgaaggccaaaaatccatggaaacgttcgattctttaacagtcttcactgccaaggaatacaatgcaacaattgagttctattgggcaccatttctccttgaatcaaactcggataatgccatcgttcatagaatatcagatagaattgtgaggaaaggttcaatcaataaacatggcaaaaattggaaaggcgttgatattattgtcttcaatacttacctatggtggatgactggcctcaagatgaaacttatgtttttcaggcacggttcttttgaagatgaaacgaaagatatcatagagctgtcaactgaggatgcctatcgtatggcaatgaaaagcatgttgagatgggtgagaaagaatatggaccgcaagaaaacaagggtctttttcactagcatgtcaccttctcatggcaagagcatagattggggaggcgaagcgggtcttaactgtttcaatgaaactactttgataaacaatgccacgtactggggatcggattgcaggaaaagcataatgggagtaattggagatgtgtttaggaaatcaaaattccccatcacatttcttaacatcacacaactctcaaattaccgcaaagatgcgcacacctcaatacacaagaagcaatggaatcccctgactcctgagcaaattgctaatcctgtcagctatgcagattgtgtgcactggtgtttgccaggccttcaagacacctggaacgaactcttatttgccaagctgttctat

SEQ ID NO: 323 - protein, 116 aa, Arabidopsis thaliana
METHVLSRIFLLVLCIYSLKTMVYGAGECGRNPPDREAIKLAPCAMAAQDTSAKVSAICCARVKQMGQNPKCLCAVMLSSTARSSGAKPEISMTIPKRCNIANRPVGYKCGAYTLP

SEQ ID NO: 324 - DNA, 515 bp, Arabidopsis thaliana
atatgcatcaactcatcactcaagaatggaaacccatgttttatctcgcattttcctcctagttctctgcatctacagccttaaaaccatggtttatggggctggagaatgtgggagaaatcctccagacagagaagccataaagttggctccttgtgcaatggctgcacaagacacatctgctaaagtgtcagcaatttgctgtgctcgagtgaaacagatggggcagaatccaaaatgcctttgtgctgtcatgctttcttccacagctaggagctccggagcaaagccagagatctcgatgactattcctaaacgctgcaacatcgctaatcgtcccgtcggttacaaatgtggagcttatactctgccttgaagcagcagacagaaagcaatagacgtgttcttcaaaaccagtctaaattgtcacatgttcacagttgtattacttggtttcaataaaaatatgaatcaaaatgatgattgatcatgaaatggtatgacttgttactgag

SEQ ID NO: 325 - protein, 116 aa, Oryza sativa
MAVIRGVVVVVLALVVVAAAAADGAGECGATPPDKMALKLAPCASAAKDPKSTPSSGCCTAVHTIGKQSPKCLCAVMLSSTTRNAGIKPEVAITIPKRCNIADRPVGYKCGDYTLP

SEQ ID NO: 326 - protein, 738 aa, Oryza sativa
GACAGCGTGACACAGGGGGTAGTTAATTACTAGTTATTCGCAGTGCGTGCGTGTGTGTGTGTGAGCGATCGATTGATCGAGATCGACATGGCGGTGATCAGGGGTGTCGTGGTGGTGGTGCTCGCGCTGGTGGTGGTGGCGGCGGCGGCGGCGGACGGTGCAGGGGAGTGCGGGGCGACGCCGCCGGACAAGATGGCGCTGAAGCTGGCGCCGTGCGCGTCGGCGGCCAAGGACCCCAAGTCGACGCCGTCGAGCGGGTGCTGCACGGCGGTGCACACCATCGGGAAGCAGAGCCCCAAGTGCCTCTGCGCCGTCATGCTGTCCAGCACGACCAGGAACGCCGGGATCAAGCCCGAGGTCGCCATCACCATCCCCAAGCGCTGCAACATCGCCGACCGCCCCGTCGGCTACAAGTGCGGAGATTACACTCTGCCATGAGCAACAAAGAGTACTGCATGCAGTGCCGGTGCCGTGTCTGTCATCCGCTTAATTTATCGAGTTTATGTCGTGTTACTTACTAAAGCTGTATGCTGTTGTGCGTTCGTGCAGTTTAGTGTCAGTGTCAAACACCAAATAAAAGGGTTCCATCTTCCGTGGGACTTCGTGATTTCAGTCCGTAGAGTTGTTTCTCCAAGTCCAGGATAGTGTGTACTTGATCATATTATCTCGGAGGGATGCAGAGACGCTCCCCTGAATTCTCTGAATAATAGTACAACTTGGTTTGTTCATCGATTCACA

SEQ ID NO: 327 - protein, 119 aa, Populus trichocarpa
MATPMKYICLFMFLAILSIAGLNQVDGAGECGKNTTPDMEAFKMAPCASAAQDENSSVSSQCCARVKKIGQNPACLCAVMLSNTAKSSGIKPEIAMTIPKRCNIADRPVGYKCGAYTLP

SEQ ID NO: 328 - DNA, 522 bp, Populus trichocarpa
gtgcattgcattgaaaaatggcgactccaatgaagtacatttgcttgtttatgtttcttgcaattctcagcattgctgggctcaatcaagttgacggggctggtgaatgtgggaaaaacaccactcctgacatggaggctttcaagatggctccttgtgcatcagcagcacaggatgagaattcttcagtttcgagccagtgctgcgctcgggtgaagaaaattggacagaacccagcgtgcctttgtgctgttatgctttccaacactgctaagagctctggaatcaagccagaaattgcaatgaccattcccaaacgatgcaacattgctgatcgtcctgtgggctacaagtgtggagcttatactttaccttgaagagtgaagaccatgaactgtgctcgccctgtaaagtactttctatcaacctgctggagtttacatcattgttgctagttcttctagctaacaaatgtagtgtaacatccagacatctaaataataaataactattggtgcttaa

SEQ ID NO: 329 - protein, 119 aa, Populus trichocarpa
MATPMKNICFVMFLATLSIALFNQVDGAGECGKTTTPDKEAFKLAPCASAAQDENASVSSQCCAKVKRIEQNPACLCAVMLSNTAKSSGIDPEIAMTIPKRCNIADRPVGYKCGAYTLP

SEQ ID NO: 330 - DNA, 360 bp, Populus trichocarpa
atggcaactccaatgaagaacatttgctttgttatgtttcttgcaactctcagcattgctttgttcaatcaagttgacggggctggtgaatgtgggaaaaccactactcctgacaaagaggcattcaagctggctccttgtgcatcagcagcacaggatgagaatgcttcagtttctagccaatgttgcgccaaggttaagagaattgaacagaatccagcctgcctatgcgctgttatgctttcgaacacagctaagagctctggaatcgacccagaaattgcaatgacaattcccaaacgttgcaacattgctgatcgtcctgtgggctacaagtgtggagcttacactttaccctga

SEQ ID NO: 331 - protein, 117 aa, Sorghum bicolor
MRGLLVLALLVAAAACLVAVRGADGAGECGATPPDRMALKLAPCASAAQNPSSAPSSSCCSAVHSIGKQSPKCLCAVMLSKTAKSAGIKAEVAITIPKRCNLVDRPIGYKCGDYTLP

SEQ ID NO: 332 - DNA, 686 bp, Sorghum bicolor
gcacgaggcggagaagcaaacagcacctgcatcacacgagcagcgagcgtgtgttggagatgagaggactcctggtgctcgccctgctggtcgcggccgccgcgtgcctcgtggcggtgcgcggcgcggacggcgcgggcgagtgcggggcgacgccgccggacaggatggcgctgaagctggcgccgtgcgcgtcggcggcgcagaacccgagctccgcgccatccagctcctgctgcagcgcggtgcacagcatcgggaagcagagccccaagtgcctctgcgccgtcatgctgtccaagaccgccaagagcgccgggatcaaggccgaggtcgccatcaccatccccaaacgctgcaacctcgtcgaccgccccatcggctacaagtgcggagattacactctgccatgagctttgagagcttacttgagcaccagtgcatgatccgtcggagttagcacgacgtctgtgggaagtgacggtgactgtgtcagtgtgtgtgtgtgtgttgccagtaaacgagacttgtgattaccatacatgtggaactccagtatgatacgggtgtctcagtctcactagatacgtgtgtacttgtactctcttgtagtcagagtcaggatgttccagagatgctgtcctgcatcctccaaataaaacttgttgtcttggacaaatttggtt

SEQ ID NO: 333 - protein, 573 aa, Arabidopsis thaliana
MVTWVLNYLLVAFLFAISYNIDAASAGITRHYQFDIQLKNITRLCKTKTIVTVNGKFPGPRVTAREGDNLQIKVVNHVSNNISIHWHGIRQLRSGWADGPSYVTQCPIRMGQSYVYNFTVTGQRGTLWWHAHIQWMRATVYGPLIILPKLHQPYPFPKPYKQVPILFGEWFNADPQAVVQQALQTGAGPNASDAHTFNGLPGPLYNCSTKDTYKLMVKPGKTYLLRLINAALNDELFFTIANHTLTVVEADACYVKPFQTNIVLLGPGQTTNVLLKTKPIYPNATFYMLARPYFTGQGTIDNTTVAGILQYQHHTKSSKNLSIIKPSLPPINSTSYAANFTKMFRSLASSTFPANVPKVVDKQYFFAIGLGTNPCPKNQTCQGPTNTTKFAASINNVSFILPNKTSLLQSYFVGKSKNVFMTDFPTAPIIPFNYTGTPPNNTMVSRGTKVVVLKYKTTVELVLQGTSILGIEAHPIHLHGFNFYVVGQGFGNFNPARDPKHYNLVDPVERNTINIPSGGWVAIRFLADNPGVWLMHCHIEIHLSWGLTMAWVVLDGDLPNQKLLPPPSDFPKC

SEQ ID NO: 334 - DNA, 2022 bp, Arabidopsis thaliana
atggttacgtgggttttgaattatcttcttgtggcatttctatttgccattagttacaacatcgatgcagcatctgcaggaatcacgcggcactaccaattcgatattcaactgaaaaacatcacaaggttgtgcaagacaaaaacaatcgtgacggtcaacggaaaattcccaggacctagagttaccgcaagagaaggagataatctacaaatcaaagttgttaatcatgtatccaataacatttctatacattggcatggtatccggcagctaaggagtggttgggcggatggaccgtcctatgtgacacaatgtccaattcggatgggacaaagttatgtttacaacttcacggtgactggacaaagaggaaccttgtggtggcatgctcatattcagtggatgagagctactgtgtacggaccattaatcattctccctaagcttcatcagccttacccttttcccaaaccctacaaacaagtccctatactctttggtgagtggtttaatgctgatcctcaagcagtggtgcaacaagctcttcagacgggtgcaggtccaaatgcatctgatgctcatacttttaatgggctcccaggtccattatacaattgctctacaaaagacacatacaaactgatggtgaaacctggaaagacgtatctactacgattaatcaatgctgcactcaatgacgaactcttcttcaccatagccaatcatacattgacggtcgtagaagcggatgcttgctacgttaaaccatttcaaaccaacatcgtgcttctcggcccgggccaaaccaccaatgtactactcaaaaccaaacctatttatccaaatgcaaccttctacatgttggcaagaccgtacttcacgggccaaggaacaattgataatacaaccgtcgcgggaattctccaataccaacatcataccaagtcttctaagaatctttctatcattaaaccatctctccctcccatcaatagcactagctacgccgcaaatttcacaaagatgtttagaagtttggcaagttctacatttccggcaaacgtgccaaaagtcgtggacaaacaatatttctttgccatcggtttaggaaccaacccttgtcctaaaaaccaaacatgccaaggaccaactaatacaacgaaatttgcagcatctatcaacaacgtgtctttcatcttaccaaacaagacttctctattacaatcatacttcgttggcaaatccaagaatgttttcatgaccgatttcccaactgcccctattattccatttaattacacgggtacgccaccaaacaacacaatggtctcaagagggaccaaagttgtggtcttgaagtacaagacaactgttgaattggtgttacagggcactagcatcttgggtattgaggcccaccctatacatcttcatggcttcaacttttatgtggtgggtcaaggctttggcaattttaacccggcccgtgacccaaaacattataacctagtcgatccggtcgaacgaaacaccatcaatatcccttccggtggatgggtcgccatccgcttccttgccgataatcccggtgtgtggctgatgcattgccacattgagattcatttgagttggggtctgaccatggcttgggttgttttggacggtgaccttccaaatcagaagctccttcctccaccctcagatttccctaaatgttgactatgaccgatccaacgcctctgcaaatgccacatcacctttttccctttcttggaatgatatttctgaagtgcaatatatgtctctttttcgtttttttttcttcattttatttctttcctctttaatacttttgtgttttgagatttctgagtttttttatccctttgcttgatgatttgttgtataaagagtgaactgaaaaacgatggtcgcgttagtaatttctgtgtacgatatgttgacgcaaaataaataatcgtaaagttttgtaataaacgaaaaaggcattagcacaaa

SEQ ID NO: 335 - protein, 585 aa, Medicago truncatula; identical to SEQ ID NO: 159

SEQ ID NO: 336 - DNA, 1758 bp, Medicago truncatula; identical to SEQ ID NO: 160

SEQ ID NO: 337 - protein, 547 aa, Oryza sativa
MGTPRGLRNAGSSSSACRFLAAFAVLLALPTLTAGLTRHYTFNVQMTNVTRLCVTKSIPTVNGQFPGPKLVVREGDRLVVKVHNHMNYNVSFHWHGILQLRNGWADGPSYITQCPIQGGGSYVYDFTVTGQRGTLWWHAHFSWLRVHLYGPLVILPKRGEGFPFPRPYKELPPIMFGEWFNADTEAVINQALQTGAGPNISDAYTFNGLPGPTYNCSSKDTYKVKVQPGRTYLLRLINSALNDELFFGIANHTLTVVEADANYVKPFTAKTLVISPGQTMNLLLTTAPNPGSPVYAMAIAPYTNTQGTFDNTTAVAVLEYAPTRASATGNNNLPLPPLPRYNDTNAVANFSSKFRSLATARYPARVPRAVDRHVLFTVGLGTDPCPSNQTCQGPNGTKFAASINNNSFVRPRVALLEAHCQRRVVPLAFNTSVELVLQGTSIQGAESHPLHMHGFNFFVVGQGFGNYDPVNDPANYNLVDPVERNTVSVPTGGWVAVRFLADNPGVWLMHCHFDVHLSWGLSMAWLVNDGPLPSQKMLPPPSDLPKC

SEQ ID NO: 338 - DNA, 1644 bp, Oryza sativa
atgggcactccccgtggcctacgaaatgccggctcctcctcctccgcatgccgcttcctcgccgcctttgccgtcctcctcgccttgccgacgctcaccgccggccttacccgtcactacacgttcaatgtgcaaatgacgaacgtgacgcggctgtgcgtgaccaagagcatcccgacggtgaacgggcagttcccggggccgaagctggtggtcagggaaggcgatcgcctcgtggtcaaggtgcacaaccacatgaactacaacgtctcgttccactggcacgggatcctgcagctgcggaacgggtgggcggacgggccgtcgtacatcacgcagtgcccgatccagggcgggggcagctacgtgtacgacttcaccgtcaccgggcagcgcggcacgctgtggtggcacgcccacttctcctggcttcgcgtgcacctctacggccctctcgtcatcctccccaagcgcggcgagggcttcccgttccctcgcccctacaaggagctgcctcccatcatgttcggtgagtggttcaatgcggatacggaggctgtcatcaaccaggccctgcagacgggagcaggccctaatatctccgacgcctacactttcaatgggcttcctggcccgacttataactgctcgtccaaagacacgtacaaggtgaaggtgcagccagggaggacgtacctgctccggctgatcaactcggcgctcaacgacgagctcttcttcggcatcgccaaccacacgctcaccgtcgtcgaggcggacgccaactacgtcaagccgttcaccgccaagacgctcgtcatctcgccggggcagaccatgaacttgctcctcaccacggcgcccaacccgggttccccggtctacgccatggccatcgcgccatacaccaacacgcagggcacgttcgacaacaccaccgccgtggccgtcctcgagtacgccccgactcgagcgagcgccaccggaaacaacaacctccccttgccgcccctgccgcggtacaacgacaccaacgcggtggccaacttctcgagcaagttccgcagcctcgcgaccgcgcggtacccggcgcgcgtgccgcgggccgtcgaccgccacgtgctcttcaccgtcggcctcggcacggacccgtgcccgtccaaccagacgtgccagggcccgaacggcaccaagttcgccgcgtccatcaacaacaactccttcgtccgccccagggtggcgctcctggaggcgcactgccagcgccgggtggtgccgctcgcgttcaacacgtcggtggagctggtgctgcagggcacgagcatccagggcgccgagagccaccccttgcacatgcacggcttcaacttcttcgtcgtcggccaagggttcggcaactacgaccccgtgaacgacccggccaactacaacctcgtcgaccccgtcgagcgcaacaccgtcagcgtgcccaccggcggatgggtcgccgttcggttcctcgccgacaatcccggggtgtggctcatgcactgtcacttcgacgtgcacttgagctggggcctgtccatggcgtggctggtcaacgacggccctctgccgagtcagaagatgttgccgccgccgtcggatcttcccaagtgctga

SEQ ID NO: 339 - protein, 576 aa, Populus trichocarpa
MGAPVPASPGILLTILLFAMSCLWAFPEVAGAKHAGITRHYKFNIKLTNVTRLCHTKSMVTVNGKFPGPRVVAREGDRLVVKVVNHVPNNISIHWHGIRQLQSGWADGPAYITQCPIQTNQTYVYNFTVTGQRGTLFWHAHLSWLRASVYGPLIIFPKRNVSYPFAKPHKEVTIMLGEWFNADPEAVIRQALQTGGGPNVSEAYTFNGLTGPLYNCSANNTYKLKVKPGKTYLLRLINAALNDELFFSIANHTFTVVEVDATYVKPFETNLLVITPGQTTNVLLKTKPIAPNASFYMLARPYFTGQGTFDNTTVAGILEYETSSNSTTFKPTLPPINATNAVANFTRKLRSLANFQFPVNVPQTVDKKFFFTVGLGNNPCPKNQTCQGPNGTKFSASVNNISMALPSTALLQSYFFKKSNGVYTSDFPSSPLHPFNYTGTPPNNTFVTNGTKLIVLPFNTNVEVVMQGTSILGAESHPLHLHGFNFYVVGEGFGNFDPNNDPKNFNLVDPVERNTVGVPSGGWVAIRFHADNPGVWFMHCHFDVHLSWGLRMAWIVLDGTLPSQKLPPPPSDLPKC

SEQ ID NO: 340 - DNA, 1731 bp, Populus trichocarpa
atgggtgctccagtccctgcatcaccaggaattcttctgacaattctactctttgctatgagctgcctctgggcctttcctgaggttgccggtgcaaagcatgcaggcatcacgcggcactacaagttcaacataaaactgacaaatgtcacccggttgtgccacactaagagcatggtgactgttaatgggaagttcccggggcctcgcgtagttgccagagaaggtgaccgtttagtggtgaaggtggtcaatcatgttccaaataacatcagcatccattggcatggaattcgacaacttcaaagtggatgggcagatgggccagcatacatcacacaatgccctattcaaacaaaccagacttatgtgtacaacttcactgttacaggacaaagaggaactctcttctggcatgctcacctctcatggcttagagcttctgtctatggacctcttatcatcttccctaagcgcaacgtttcttacccatttgccaaaccccacaaggaagtgactatcatgttgggagagtggttcaacgctgatcctgaggcagtgattagacaggctttacagacaggaggggggccaaatgtctctgaagcctacacctttaatggacttacaggtccactatacaattgctcagcaaataatacatacaaactaaaggtgaagccgggaaagacatatcttctccgattgatcaatgctgcactcaacgatgagctttttttcagcattgcaaaccacaccttcaccgttgttgaagtggatgcaacttatgtgaagccttttgagaccaaccttctggttatcacaccaggacagaccacaaatgttcttctgaagaccaaacccattgcccccaatgcatcattctacatgttagcaagaccatattttactggccaaggcacatttgacaacacaactgttgcagggatactcgagtatgaaacttcttcaaactcgacaacttttaaaccaacccttcctccgattaatgctacaaatgctgttgcgaatttcacaagaaaacttcgcagtttggctaattttcaattcccggttaatgtccctcaaacagtggacaagaaatttttcttcacggttggtctgggaaacaacccgtgcccaaaaaatcagacatgtcaagggcctaatggcacgaaattttcagcttctgttaacaacatctccatggctctcccttcaacagcactccttcaatcctattttttcaaaaaatcaaatggggtttacacctctgattttccaagctctcctctccatccattcaactacacagggaccccaccaaataatacttttgttaccaatggtaccaagcttatagtgcttccatttaacacaaatgtggaggtagtgatgcagggcactagcattttgggtgcagagagccaccctctccatctccatggcttcaatttctatgttgttggagaagggtttgggaattttgatccaaataatgaccccaagaactttaatcttgttgatcctgttgaaaggaacactgttggtgtgccttctggtggctgggtggcaattcgttttcatgcagacaatccaggagtatggtttatgcactgccacttcgatgtacatttgagctgggggttaaggatggcatggattgtcttggatggaacacttcccagtcagaagctccctcctccaccatctgatcttcccaagtgttga

SEQ ID NO: 341 - protein, 254 aa, Arabidopsis thaliana
MAKMQLSIFIAVVALIVCSASAKTASPPAPVLPPTPAPAPAPENVNLTELLSVAGPFHTFLDYLLSTGVIETFQNQANNTEEGITIFVPKDDAFKAQKNPPLSNLTKDQLKQLVLFHALPHYYSLSEFKNLSQSGPVSTFAGGQYSLKFTDVSGTVRIDSLWTRTKVSSSVFSTDPVAVYQVNRVLLPEAIFGTDVPPMPAPAPAPIVSAPSDSPSVADSEGASSPKSSHKNSGQKLLLAPISMVISGLVALFL

SEQ ID NO: 342 - DNA, 1049 bp, Arabidopsis thaliana
catcttctaagaaagaaacaaagaaagacttcacattttaccattatttgctctgagctcagtaggagagttcaagaaacaatggcaaagatgcaattatcaatctttatcgctgtcgttgcgcttatcgtctgctctgcatctgctaaaaccgcaagccctccagctccagtgctgccaccgacaccagctccagcaccagccccggaaaatgtgaatctcaccgagcttttaagtgtagctggtccgttccacacattcctcgactaccttctctcgactggagtcattgagactttccaaaaccaagctaacaacactgaggaaggcatcacaatctttgtccctaaagatgatgctttcaaagctcagaagaatcctcctttgtcaaatctcacaaaggatcagcttaagcagcttgttctcttccatgctctgcctcattactattcgctttcggaattcaagaacttgagccaatctggtccagtgagcacctttgctggtggtcaatactccttgaaattcactgatgtttctggcacggttaggattgattctttatggaccaggactaaagtcagcagcagtgttttctccactgaccctgttgcggtttaccaagtgaaccgcgtgcttctacccgaagcaatctttggtactgatgtccctccaatgcctgctccagctcctgctcctatcgttagtgctccttcggattctccttcagttgctgattctgaaggagcttcttcaccaaagtcctcacacaagaactccggacaaaagctgctacttgcaccaatctccatggttatttccggtttggtggcattgttcttgtgatcagatggttttgcagattgagttatgtttttaagttacaatgtgaaagattgtattacatcatttgaattgtctttttgatttttgaaacccattttttattatacatttttatcattattattgtttgtcattacgattgttgtgaattgaaattgttcctccattttgcttttctttagttaattttgcttcatttgcaa

SEQ ID NO: 343 - protein, 262 aa, Medicago truncatula
MKVSMIFLVSTLLLLSSSAFAKTVSPPSPPAESPTPAPAPAPTPDFVNLTELLTVAGPFHTFLQYLQSTKVLDTFQNQANNTEEGITIFVPKDSSFASLKKPSLSKLKDDEIKQVILFHALPHFYSLADFKNLSQTASTPTFAGGDYTLNFTDNSGTVKINSGWSITKVTSAVHATDPVAIYQVDKVLLPEAIFGTDIPPVLAPAPTPEIAPAADSPTEQSADSKSSSPSSSPDRSSSYKIVSYGIWGNLVLATFGLVVVIL

SEQ ID NO: 344 - DNA, 789 bp, Medicago truncatula
atgaaggtttcaatgatttttcttgtgtccactctgctgcttctgagctcatcggcatttgctaaaactgtaagtccaccctctccccccgctgagagtccaactccggctccagcaccagcacctacaccagatttcgtaaacctcactgaattactcactgttgctggtccatttcacacttttcttcaataccttcaatccacaaaagttttggacactttccaaaaccaagcaaacaacactgaagaaggaatcactatctttgttccaaaagacagttctttcgcatcattgaagaaaccttctttatccaaactcaaagatgatgagataaaacaagtgattcttttccatgctttgccacatttctattcacttgctgatttcaaaaaccttagccaaactgcctcaactccaacatttgccggtggtgattacactttgaatttcaccgataattccggaactgtcaaaattaattcaggatggtcaatcactaaggtgactagtgcagttcatgctactgatcctgttgcaatttatcaagttgataaggttttgcttcctgaggcaatatttggcactgatattccacctgttctggctcctgcacccacaccagaaattgcgcctgcagccgattctccaactgaacaaagtgctgacagcaaatcgtcttcaccttcatcttcaccagatcgttcgtcttcttacaagatcgttagctatggaatttggggcaaccttgtgttggcaacttttggtttggtggtggtaatcttgtga

SEQ ID NO: 345 - protein, 267 aa, Oryza sativa
MEFKAAMFAAAVVAVLLSSPSPALAQKKSPPAAPSPVSLPPSLAPAPAPAPHYVDLAELLSVAGPFHTFLNYLEKTNVIETFQSQANKTKEGVTIFVPKDSAFAAIKQSTFSNLTGDQLKTLLLYHAFPKFYSLAEFKNLSELNPVNTFAGAPYTLNLTDDMGTISVQSMWSRPKISSSVYATRPVAVYALNKVLLPMQIFSKDPPLAPAPAPAPVSGASDLAPGPASGKTGAGGGKADSTSAACGVGAGVVNGLVMALAGSLMLLW

SEQ ID NO: 346 - DNA, 1264 bp, Oryza sativa
atgcacctcttggttgagaggtgtggtcgtggtggtgcctactgacctgcaatgcaatggccgcaacagccgccaccccccatatgaatctcataatttattctcttcctttccacacaaacaccaacctttctatatagcatcccctcccctcaagtctcaacactttgccgtccagttgccctcttcttctcttctcttctccttcccctgctctgctcagggatcaggatcagaggagaagagaagatggagttcaaagcagccatgttcgcggccgccgtcgtagccgtcctcctatcgtcgccgtcaccggcattggctcagaagaagagcccgccggcggcgccgtcgccggtgtcgcttccaccgagcttggctccggcgccggcgccggcgccgcactacgtcgacctcgccgagctcctcagcgtggccgggccgttccacacgttcctcaactacctggagaagacgaacgtcatcgagacgttccagagccaggcgaacaagaccaaggagggcgtcaccatcttcgtccccaaggactcggcgttcgccgccatcaagcagtccaccttttccaacctcaccggcgaccagctcaagacgctgctgctgtaccacgcgttccccaagttctactccctggccgagttcaagaacctcagcgagctcaacccggtgaacacgttcgccggcgcgccgtacacgctgaacctcaccgacgacatgggcaccatctccgtgcagtcgatgtggtccaggcccaagatctcgagcagcgtgtacgccacgaggcccgtggcggtgtacgcgctcaacaaggtgctcctgcccatgcagatcttcagcaaggacccgccgctggcgccggcgcccgccccggcgccggtgtccggggcgtccgacctcgcgcccggcccggcgtccggcaagacgggcgccggcggcggcaaggcggactcgacgagcgccgcgtgcggcgtcggcgccggcgtcgtcaatggcttggtgatggcattggctggtagcttgatgctcctgtggtgatgatcagagagagagagagagagagagttcttggagtcaaatttgcaacagcagcacattgttcatgcttctccacacttgattctattttgaattgatttgaaagagccattcttttggacatagtaggcaatgtttgtaggatcgaattggagtatttttttttacaacgtattacgatcataattcataattactcatctgctgatgg

SEQ ID NO: 347 - protein, 263 aa, Populus trichocarpa
MEFSMIIMFSSTLLFLCTPVAYAQTAASPPAPTPTPSSSPAPAPTPPYVSLTDLLSVAGPFHTFLSYLESTKVVDTFQNQANNTDEGITIFVPKDDAFKNLKKPSLSNLTQDQVKQLILFHALPHYYALADFKNLSQVSPVSTFAGAGGYALNFTDVSGTVHLDSGWSKTKVSSSVHSTDPVAVYQVDKVLLPEAIFGADIPPAPAPAPAPETSLAADSPSSDSTGDGSAPGTSPPNSSYRIFGVDIWSQLVLALIGVLVLFL

SEQ ID NO: 348 - DNA, 926 bp, Populus trichocarpa
atgcagtgttaactcatttcattttgtgctgcatcattgttagcattggcaatttggtatcccctaaacacaaccatttctctctgaattcttggtcaggaatttagagaattttgttaagaagaaaaaaaaacatggagttttccatgattattatgtttagtagcacgctgttgtttttgtgcactccagtagcatatgctcaaacggcagctagtcctccagcaccaaccccaactccgtcctcatcaccagcaccagcaccaacacctccttacgttagcctcactgatttgctctctgttgctggcccattccacaccttccttagctaccttgaatccactaaggtcgttgacaccttccaaaaccaagccaacaacactgatgaaggcattaccatcttcgtaccaaaagatgatgccttcaaaaatcttaagaagccttctttgtcaaacctaactcaagaccaggtgaagcaactcattcttttccatgccttgccgcactattacgccttggctgatttcaagaaccttagccaagtaagccctgttagcacatttgctggtgcaggcggatatgctttgaatttcacagatgtatctgggaccgtgcaccttgattcaggatggtcaaaaaccaaagttagcagtagtgtgcattcaactgatcccgttgcagtttatcaagttgacaaagtcctccttcctgaggcgatatttggtgctgatatacctccagccccagccccagccccagcccctgaaaccagccttgctgcagattctccatcatctgacagtactggagatgggagcgctccaggaacttcccctccaaattcttcttataggatctttggtgtagatatttggagtcaattggttttggcactcataggtgtgctggtcctgttcttgtag

SEQ ID NO: 349 - protein, 185 aa, Arabidopsis thaliana
MAKRFLLLLPLLSTILLLSVSVTESEAYSTTKPCQGYKPDKFTHLHFYFHDVISGDKPTAVKVAEARRTNSSNVNFGVIMIADDPLTEGPDPSSKEVGRAQGMYALTAMKNISFTMVFNLAFTAGEFNGSTVAMYGRNEIFSKVREMPIIGGTGAFRFARGYAQAKTYKVVGLDAVVEYNVFIWH

SEQ ID NO: 350 - DNA, 691 bp, Arabidopsis thaliana
atcatatcactaacatggctaaacgttttctccttcttcttcctcttttgtcaactattctacttctttccgtatccgttacagaatccgaagcttactccacaacaaagccgtgtcaaggctacaagccggataaattcacccacctccacttttacttccatgacgtcatctccggtgacaaacctaccgccgtcaaagttgcggaagcccgccgaacaaactcctccaacgtcaattttggcgtgattatgatcgctgatgatccgttgaccgaaggaccagacccgagctcaaaggaagtgggaagagctcaagggatgtacgcattgacagccatgaagaacataagcttcacaatggtctttaacttggcttttacggcgggagagtttaatggaagcaccgtcgcgatgtatggacggaatgagatattttcgaaggtgagagagatgccaattattggaggaaccggtgctttcaggtttgctagaggctatgcacaggccaagacttataaggttgttggtctagatgccgtggtcgagtataatgtcttcatttggcattaatcatttgcatattgtctaatgtctttccgaaacaaattgtttcactttggttttcttatattgtgttctgtttttgttgtgtcgtttaaagtttaaaaggtgtagttgtttgaactttg

SEQ ID NO: 351 - protein, 144 aa, Oryza sativa
MAAARFPLLVLCLLPIIVCSVVDAELTHLHFYFHEVDAGTPNATVVNVASLHRNSSTFGDVNVLDNALREGPDPASRLIGRAHGLAVHASLDETGASRPSTSSSPTTARTAAARWPRRATSSRRARRSGASSAARASSGSRAGT

SEQ ID NO: 352 - DNA, 792 bp, Oryza sativa
gcacagatcgaggagataattagctcactccatggccgctgctcggtttcctctccttgtcctctgcctcctgccgatcatcgtctgcagcgtcgtggacgcggagctgacccatctccacttctacttccacgaggtcgacgccggcacgcccaacgccaccgtcgtcaacgtcgccagccttcaccggaactcgtcgacgttcggcgacgtgaacgtgttggacaacgcgctgcgggaggggccggacccggcgtcgcggctgatcgggagggcgcacggcctcgcggtgcacgcgtcgctggacgagacgggcgcctcacggccatcaacttcgtcttctccgactacggcgcgtacagcggcagcacgctggccacgcagggccacttcatcacgacgggcccgtcggagcggagcatcgtcggcggcacgggcaagctccggttcgcgcgcgggtacatgaccagcaagcttctcagctccacggacaccgccatcgtcgtcgtcttcgacatgtacttcaccctcgaccattgaatactactccgtggtgtgttatatatcgtgcagtgcttgctttggtgttcggttgaacatatgtatgcacggcgatcgtgacgaatactggggttcggagaattcttttccgacccatcgtctcataggcccaattcaccactcctacgctgtactgacacactcatgtaaaaataaactcggtgttataattgctcagggcaaagcatccttataaataacatttcgcctcaaattctcgaggtaggatca

SEQ ID NO: 353 - protein, 352 aa, Arabidopsis thaliana
MGRHSCCFKQKLRKGLWSPEEDEKLLNYITRHGHGCWSSVPKLAGLQRCGKSCRLRWINYLRPDLKRGAFSQDEESLIIELHAALGNRWSQIATRLPGRTDNEIKNFWNSCLKKKLRRKGIDPTTHKPLITNELQSLNVIDQKLTSSEVVKSTGSINNLHDQSMVVSSQQGPWWFPANTTTTNQNSAFCFSSSNTTTVSDQIVSLISSMSTSSSPTPMTSNFSPAPNNWEQLNYCNTVPSQSNSIYSAFFGNQYTEASQTMNNNNPLVDQHHHHQDMKSWASEILHYTEHNQSSETVIEAEVKPDIANYYWRSASSSSSPNQEAATLLHDANVEVYGKNLQKLNNMVFDQSL

SEQ ID NO: 354 - DNA, 1387 bp, Arabidopsis thaliana; identical to SEQ ID NO: 248

SEQ ID NO: 355 - protein, 367 aa, Medicago truncatula
MGRHSCCYKQKLRKGLWSPEEDEKLLNHITKYGHGCWSSVPKQAGLQRCGKSCRLRWINYLRPDLKRGTFSQEEENLIIELHSVLGNRWSQIAAQLPGRTDNEIKNLWNSCLKKKLRQKGIDPVTHKPLSEVENVDEEEGKTRSQEKTAEISESDELNIVRSESTSKSDAVSYEPKQSSIVLKGYATEMEVEGSCSNYLMGNYPIQMNYTSTDNIPNNPNSSHWFNQTGLKPFDMNSEFTSTSNIMSILPQTNTSFLPNAFCYKPSEDVSMSSSSFPMKNSILSSWGITDCDTSIKENQTEEEEEEAKWNEYLHNPMLMLQNQASESLCNEIKPDTNLGPDGLGDILPHSKQQESSQSYNIAAFGQV

SEQ ID NO: 356 - DNA, 1104 bp, Medicago truncatula
atgggaagacactcttgttgctacaagcagaagcttaggaaaggtctatggtcacctgaggaggatgaaaaacttttgaatcatattactaaatatggtcatggatgttggagttcagttcctaagcaagcaggtcttcaaagatgtggtaagagctgtaggcttaggtggattaattacttaaggcctgatttaaaaagaggtacattttcacaagaagaagaaaatctcatcattgaacttcattcagtactagggaatagatggtcacaaattgctgcacaattgccagggaggactgataatgaaataaagaatctttggaattcttgcttaaagaagaaactgagacaaaagggtatagaccctgtcactcataaaccactttctgaggtagaaaatgttgatgaggaggagggaaaaactagaagccaagagaaaacagcagaaatatcagaatcagatgaattgaacattgtgagatcagaaagtacttctaaatcagatgctgtttcatatgaaccaaaacaatcttcaattgtcctaaaaggttatgcgactgaaatggaagtggaaggttcttgttccaactatttgatgggaaattaccctattcagatgaattacacatccactgataatattccaaataatcctaactcttctcattggttcaaccaaacaggattaaaaccttttgatatgaactctgaatttacttcaacttctaacatcatgtcaattcttccacaaactaatacctcatttcttcctaatgctttttgctacaaaccatcagaagatgtttctatgtcttcatcttctttccctatgaagaatagtatcttatcttcttggggaattacagattgtgacacctctattaaagagaatcaaacagaagaagaagaagaagaagccaagtggaatgagtatcttcacaatccaatgttaatgctacaaaatcaagcatctgaatctttatgcaatgaaataaagcctgacacaaatttaggccctgatggtttaggggacatattgccacattccaagcaacaagaatcttctcaatcttataatatagcagcttttggacaagtgtag

SEQ ID NO: 357 - protein, 301 aa, Oryza sativa
MGRHACSAAGVQQKLRKGLWSPEEDEKLYNHIYRYGVGCWSSVPKLAGLQRCGKSCRLRWINYLRPDLKRGSFSQQEEDAIVGLHEILGNRWSQIASHLPGRTDNEIKNFWNSCLKKKLRQRGIDPSTHQPISTAAAAAAAALDTSTQDQKPPATADGFALKQQQQVFDPFPVIDSFGSGFDATGMPLYGHLGGKDAAGFVDYSSVLDVSENLGYGESSSNSSNWNCGVGAPEVNNALESEPLHWATESKVEPFVGYGEGDAMEHKFGLPCHGQQEQGMTHFDFDVSRSMVVGDFNFEYFR

SEQ ID NO: 358 - DNA, 1556 bp, Oryza sativa
acgatatcaagccgcacgcaccaggtagtacacacagagaagaggagtactaggtagagagacgcttggctccgtggctcgttggttgattgcttaaaggccacttgatcgctgctcgatctgctgcctccctcgcgcgcgcgcaccgtacgtgtgtgtgtgcagtagttctcggcacgcttccccatatataccccctggatcgggcgcccagccggccgcctcgatcgacagagagatcgatagacagatacacgccggcaagggcaacgaacccagcggcaggtagctgctcgcgtgtcgggcgggaatgggacggcacgcgtgctctgccgccggtgtccagcagaagctgcgcaaggggctctggtctcccgaggaagacgagaagctctacaatcacatctaccgctacggcgtcggttgctggagctccgttcccaagctcgcagggctccagaggtgcggcaagagctgcaggctgcggtggatcaactacctgcgccccgacctgaagcggggcagcttctcgcagcaggaggaggacgccatcgtcggcctgcatgagatcctaggcaacaggtggtcgcaaatcgcgtcgcacttgccggggaggacggacaacgagatcaagaacttctggaacagctgcctcaagaagaagctgaggcagcgcggcatcgaccccagcacccaccagcccatctccacggctgctgctgctgcggcggcggcattggacacgtcgacgcaggaccagaagccgccggccaccgccgacggcttcgccctgaagcagcagcagcaggtgttcgacccgttcccggtgatcgacagcttcggcagcgggttcgacgccacgggcatgccattgtacggccacctcggcggcaaggacgcggccgggttcgtggactacagcagcgtgcttgacgtgtcggagaacctgggctacggcgagagctccagcaacagcagcaactggaactgcggcgtgggcgcgccggaggtgaacaatgcgctcgagagcgagccgctgcattgggccaccgagagcaaggtcgagcctttcgtgggctacggcgagggggacgccatggagcacaagttcgggctgccctgccatgggcagcaagagcagggcatgacacatttcgacttcgacgtcagccggagcatggtggtcggcgacttcaacttcgagtacttccgatgaggttcttgtgaattaagccattatcgtatatacaatattcttccaaggcattttacacagagggcatgaccaaccgggagagtagagactgtactctgttaattttcactagtccatactccttaattaacacctttttatgatttctgcatgggtaaaaatataaataaagggtatagaaatgtgaacactgtgtagttaattactactatgagattttgtaagaataattaagtttcttacacttgtactctgtaagttgctgccactgggaggactgtgtaacgtgtattcctctcctgaagaaggaacaatcaaggttctcactaattgcttgccc

SEQ ID NO: 359 - protein, 137 aa, Populus trichocarpa
MGRHSCCLKQKLRKGLWSPEEDERLFNYITRFGVGCWSSVPKLAGLQRCGKSCRLRWINYLRPDLKRGMFSQQEEDLIISFHEVLGNRWAQIAAQLPGRTDNEIKNFWNSCLKKKLMKQGIDPATHKPLSQVEVKEE

SEQ ID NO: 360 - DNA, 411 bp, Populus trichocarpa
atgggacgacattcttgttgtttgaagcaaaaactaaggaaaggtttgtggtcacctgaagaagatgagagactgttcaattatataactagatttggtgttggttgctggagttctgttcctaaactagctggtttgcaaaggtgtggaaagagttgcagattaagatggataaactacttgagacctgaccttaaaagaggaatgttctcacagcaagaggaggatctcataatcagttttcatgaagttttgggtaacaggtgggctcaaattgctgcacagttaccaggaagaacagataatgagattaagaacttttggaattcctgtctgaagaagaagcttatgaagcaaggaattgacccagcaacccacaagcctctaagtcaagtggaagtgaaggaggag

SEQ ID NO: 361 - protein, 146 aa, Populus trichocarpa; identical to SEQ ID NO: 253

SEQ ID NO: 362 - DNA, 438 bp, Populus trichocarpa; identical to SEQ ID NO: 254

SEQ ID NO: 363 - protein, 525 aa, Arabidopsis thaliana
MTVMNHRHKQCHFLLLLLITVFSAALDGVSSETDVGGFDYGEALSKSLLYFEAQRSGRLPYNQRVTWRDHSGLTDGLEQGVDLVGGYHDAGDHVKFGLPMAFTVTMLSWSVIEYGDSLASTGELSHALEAIKWGTDYFIKAHTSPNVLWAEVGDGDTDHYCWQRPEDMTTSRRAFKIDENNPGSDIAGETAAAMAAASIVFRSTNPHYSHLLLHHAQQLFEFGDKYRGKYDESLKVVKSYYASVSGYMDELLWGATWLYRATDNEHYMSYVVDMAHQLGGLSWAMSEFSWDVKFAGVQLLASMLLKEEKHKQHSKVLQQYKSKADHYLCSILNKNINGTNVQRTPAGLLYVRQWNNMQYVSTASFLLTVYSDHLRKSNTDLECHEGTVTPDEMLGFAKSQIDYILGSNPMETSYLVGYGPKYPIRVHHRGASIASFKEHKGFIGCTQGYDNWYGRSEPNPSVLVGALVGGPDHQDDFDDRRGNYVQTEACTYNTAPLVGVFARLIELEEQKLEEEDVSLVATYKR

SEQ ID NO: 364 - DNA, 1862 bp, Arabidopsis thaliana
atagagagagactagtgagtgagagagtccatcgctttctttctttctctctctcgctctctcttcatctccaacagagacttctttctagagaaagagatcttcacaaatatgactgtgatgaatcaccgacacaagcaatgtcattttctcctcctccttctgatcactgtcttctctgccgcgttggatggtgtttcttccgagacagacgtcggagggtttgactacggtgaagcattgtctaaaagcttactctactttgaagctcagagatcaggaagacttccgtacaaccagcgcgtgacttggcgtgatcactctggtctcaccgatggtcttgaacaaggggttgatttagtgggaggatatcacgacgccggagaccatgttaaatttggacttccgatggcttttacggtgacaatgttgtcatggagtgtaatagagtacggtgactcactcgcttccaccggagagttatctcacgcgcttgaagccatcaagtggggaacagactacttcatcaaggcacacacaagcccaaatgtcttatgggccgaagttggcgacggtgacactgaccactactgttggcaaagaccggaggacatgacgacttcacggagagctttcaagatcgatgagaataatccgggatcagatatcgctggagaaactgcggcggctatggcggcagcttcgatcgttttccgttcaacaaatccacattactctcaccttctcttgcaccatgcccaacaattgtttgagtttggagacaagtacagaggaaaatacgatgagagtctaaaagttgtgaaaagttattatgcctcggtgagtgggtacatggacgagcttttatggggtgccacttggctttatcgagccaccgacaatgagcactatatgagttatgtggttgacatggctcaccaactaggtggcctttcttgggccatgtccgagtttagctgggacgtcaagttcgccggtgttcaactcctagcttccatgttgctaaaagaagaaaagcacaagcaacattctaaagtcctacaacaatacaaatcaaaggcggatcattacctatgctcaattctcaacaagaacatcaacggcacaaacgtccagcgaactcctgccggtttactctacgtccgacaatggaacaatatgcaatacgtatccacagcatctttcctcctaaccgtatattctgatcatctccgaaaatcaaacaccgatctcgagtgtcacgaaggaaccgtaactcctgacgagatgcttggctttgcgaaatctcaaatcgattacattttaggatcaaatccaatggaaacaagttatctagtcgggtacggtccaaaatacccgattagggttcatcatcgaggcgcgtctatcgcttcttttaaagagcacaaaggttttataggatgtactcaaggatatgataattggtatggacggtccgagccaaatccgagtgttttagtcggggctttggttggaggaccggatcaccaggatgattttgatgaccggaggggtaattacgttcaaacggaggcttgtacgtacaatactgctcctttggtcggtgtgtttgcgagacttatagagcttgaggagcaaaaacttgaagaagaagatgtgagcttggttgcaacttataagagatagtttttatttaatcaatacaaaaaaaagaaagaaaatgtggttttattttgcacccattttgccatttctatattgttagagtttttcttctcaactttttttttttgttttgtttttaaataaaaagtgtgtataaaatatcaattatcaatatagatttttgtcaattttat

SEQ ID NO: 365 - protein, 517 aa, Medicago truncatula
MEKKKHHFLMQHCCLFLFIFTIFTTNSQAFDYGDALSKSLLYFEAQRSGRLPYNQRVAWRDHSALIDGLEQGVDLVGGYYDAGDHVKFGLPMAFTVTMLSWGAIEYLQEIEGAGELQHTMEAIKWGTDYFIKAHTSPNVLWAEVGDGDTDHYCWQRPEDMTTSRRAFKIDENNPGSDLAGETAAAMTAASIVFKKTNPHYSHLLLHHAQQLFEFGDKYRGKYDVSVGVVKSYYASVSGYMDELLWAATWLYKATDKEEYLDYVIKNANLFGGTGWSITEFSWDVKYAGLQLIASQFLNQAKHKKHSDILEQYRSKAEYYICSCLNKNINGTNVERTPAGLLYVRQWNNMQHVSTASFLLTIYSDYLKNTNQKLTCHGGILDHKEILSFAKSQVDYILGSNPMNMSYLVGYGPSYPKRVHHRGASIMSYKENKGFIGCTQGYDNWYSKEDPNPNVLVGALVGGPDWQDNFEDKRNNFMQTEACTYNTAPLVALFAKFLHIEDNKMVHDCNSLLVASFK

SEQ ID NO: 366 - DNA, 1554 bp, Medicago truncatula
atggagaaaaagaaacaccattttctcatgcaacattgttgtcttttccttttcatcttcaccatttttactactaactctcaagcttttgattatggtgatgccctttcaaagagcctcctttattttgaagcgcaacgttcagggagattaccttacaatcaacgcgtcgcttggcgcgatcattctgctctcattgatggtcttgaacaaggggtggatttggtaggagggtattatgatgcaggtgatcatgtaaaatttggtttaccaatggcatttactgtgacaatgctttcatggggtgctatagaatatttgcaagaaattgaaggtgctggtgaattacaacacacaatggaagcaatcaaatggggcactgattatttcatcaaagctcacactagtccaaatgttttgtgggcagaagttggtgatggtgacactgatcattattgttggcaaagaccagaggacatgacaacttcaaggagagcattcaagatagatgaaaacaatcctggttcagatcttgctggagagacagcagcagctatgacagctgcttctattgtatttaagaaaacaaatccacattactctcacttacttctacaccatgctcaacagttgtttgagtttggagacaagtatagaggaaaatatgatgtgagtgttggagtagtgaaaagttactatgcgtcggtgagtggatacatggatgagttgttatgggctgccacgtggctttataaggccaccgacaaagaagagtatttagattatgtaattaaaaatgctaatctctttggtggcactggttggtccataacagagttcagctgggatgtcaaatatgcaggtctccaactcattgcttctcagtttttaaaccaagcaaaacacaagaaacatagcgatatacttgaacaatataggtcaaaagcagagtactatatatgttcatgtctcaacaaaaacatcaatggaaccaatgtggaaagaactccagctggattactatatgtcagacaatggaacaacatgcaacatgtttcaacagcatcatttttactcacaatctactctgactatctcaaaaacaccaatcaaaaactcacatgtcatggaggcattttggatcacaaagaaattctaagttttgcaaaatcacaagttgattacattttgggctctaaccctatgaacatgagctacttagtgggttatgggcctagttaccctaaaagggtccatcatagaggagcatcaattatgtcatataaggagaataaagggtttattggttgtactcaagggtatgataattggtatagtaaggaagatcctaaccctaatgttttggttggagctttggttggtggtcctgattggcaagacaattttgaagataaaaggaacaatttcatgcaaactgaggcttgcacatacaatactgcccctttagtagctctttttgcaaagttcttgcatattgaagacaataaaatggtacatgattgtaattcacttttggttgcttcctttaaataa

SEQ ID NO: 367 - protein, 534 aa, Oryza sativa
MSDVSGRFVVAAAVVAVSLAMAAAAAAHDYGEALSKSLLYFEAQRSGRLPYNQRVRWRGHSGLTDGLEQGVDLVGGYYDAGDHVKFGLPMAFTVTMLSWSVLEYGEEIAAAGELGHALHAIKWGTDYFIKAHTHPNVLWTQVGDGDSDHYCWQRPEDMTTSRHAYKVDAENPGSEVAAETAAAMAAASIVFRRAGDAHYAHLLLHHAQQLFEFGDKYRGRYDESVEVVKNYYPSSSGYKDELLWAALWLHRATGRREYLDYAVDNADDFGGTGWAVSEFSWDIKYAGLQVLASKLLVEEKHLSSQQREVLEKYRSKAEYYVCSCMGRNPGGAAHNAGRTPAGLLFIRPWNNLQYVSNAAFLLTVYSDVLSYLSLPLLCPDPDAAADEAAPAAADAGEVLEFARSQADYILGTNPMATSYLVGYGEAYPRRVHHRAASSASYARDRDFIGCLQGFDSWYSAAAENPHDLVGAVVGGPNGNDVFTDHRGAYMQTEACTYNTAPMVGVFSRLMELERRRRGEDAPPSSTSPVAEDDL

SEQ ID NO: 368 - DNA, 2295 bp, Oryza sativa
taccccattttgattgcttcctcccctcctctcttgatttgaagcccaattcttctccattaatctctcctccctctcacatatacccaaacacacatgcatatatatacatatatatacatgaatgcagctaactagcatatgtgtctgtgtgtgttcatcagtgatcagtagtgttcttgttcttgttcattggcagctggaggttcttgttcatttgccttagctggaagtgattaaatcagtagccattgttgtttagtggcgccattaatcttcagttatcagtttccattccgggagatcaggcggtggtcagctggcacctgcatgcatatgcaggctcattgattgattcgattttgggaagagagttattagtgatcgatcttggctggatcgattgagcttgatcatccggtggtgatatttctggattcttgtatatttgtgaggggtgtgagctgtttgatcgatgtgctgtggttgggcggcggcgtaggatgagcgacgtctccggccgcttcgtggtggccgcggccgtggtcgccgtgtcgctggccatggcggcggcggcggcggcgcacgactacggcgaggcgctgtcgaagagcctgctctacttcgaggcgcagcggtcgggccgcctgccgtacaaccagcgcgtgcggtggcgcggccactccggcctcaccgacggcctcgagcaaggggtggacctggtgggcgggtactacgacgccggcgaccacgtcaagttcgggctgcccatggcgttcaccgtcacgatgctgtcgtggagcgtgctggagtacggcgaggagatcgccgccgccggcgagctcggccacgccctccacgccatcaaatggggcaccgattacttcatcaaggcgcacacccaccccaacgtcctctggactcaggtcggcgacggcgactcggaccactactgctggcagcggccggaggacatgacgacgtcgcggcacgcgtacaaggtggacgccgagaaccccgggtcggaggtcgccgcagagaccgccgccgccatggccgccgcatccatcgtcttccgccgcgccggcgacgcccactacgcccatctcctcctccaccacgctcagcagttgtttgagtttggggacaagtacagggggagatacgacgagagtgtggaggtggtaaagaactactacccatcatcaagtgggtacaaggatgagctgctgtgggcggcgctgtggctgcaccgtgccaccggccgccgcgaatacctcgactacgccgtcgacaacgccgacgacttcggcggcaccggctgggccgtctccgagttcagctgggacatcaagtacgccggactccaagtcctcgcttccaagctgctggtagaggagaagcatctgagctcgcagcagcgcgaggtgctggagaagtacaggtcaaaggcggagtactacgtgtgctcctgcatgggccgcaaccccggcggcgccgcccacaacgccggccgcactccggcgggcctcctcttcatccgcccgtggaacaacctccagtacgtctccaacgccgccttcctcctcaccgtctactccgacgtcctctcctacctctccctccccctcctctgcccggaccccgacgccgccgccgacgaggccgctcctgcggcggcggacgccggcgaggtgctggagttcgcgaggtcgcaggcggattacatactggggacgaacccgatggcgacgagctacctcgtcgggtacggcgaggcgtacccgcggcgggtgcaccaccgcgcggcgtcgagcgcgtcgtacgcgcgcgaccgcgacttcatcgggtgcctccaggggttcgactcgtggtacagcgcggcggcggagaacccgcacgacctcgtcggcgccgtcgtcggcgggcccaacggcaacgacgtgttcaccgaccaccgcggcgcgtacatgcagacggaggcctgcacgtacaacacggcgcccatggtcggcgtcttctccaggctcatggagctcgagcggcggcggcgcggggaagacgcgccgccgtcgtcgacgtcgccggtggcggaggatgatctgtagtagatgttgtataagttaggagatgagagaatttatatgaccccctctgattggtgaatggtgataataataaaaaaaatgaaaaaagggaaattttatacattcgtttttgtttatatgattcgtagagggtttttttttcatgttttgaaatttgaacatagaagatgtagggattaaaggaatg

SEQ ID NO: 369 - protein, 472 aa, Populus trichocarpa
DYGDALKKSLLYFESQRSGRLPYNQRVTWRHHSGLTDGLEQGVDLVGGYYDAGDHVKFGLPMAFTVTMLSWTVIEFQHQIAVAGELEHALEAIKWGTDYFIKAHTSPNVLWAEVGDGDTDHYCWQRPEDMTTSRQAYRIDENNPGSDLAGETAAAMAAASIVFKKTNPHYSHLLLHHAQQLFEFGDKYRGKYDENMGVVKSYYASVSGYKDELLWGALWLYKATDNEKYLEYVINNAHCFGGTGWAMEEFSWDVKYAGLQIMAAKLLVEEKHREHGDTLEQYRSKAEHYLCSCLNKNNGTNVNRTPGGLLHIRQWNNMQYVSTAAFLLTVYSDFLLNSNQKLKCHGGSVDHEEILGFAKSQVDYILGSNPMNMSYLVGYGPKYPARVHHRGASIVSYRENKGFIGCTQGYDNWYGREEPNPNVLVGALVGGPDCQDNFTDQRSNYMQTEACTYNTAPLVGVFAKLLQMEGQK

SEQ ID NO: 370 - DNA, 1416 bp, Populus trichocarpa
gattacggtgatgccttaaaaaagagccttctttacttcgaatcacaacgttccggtcgcttaccctacaaccagagagtaacatggcgtcaccattctggactcactgatggcttggaacaaggggtggatttggtcggaggatattatgatgcaggggaccatgtaaaatttggactgccaatggccttcaccgtgacaatgctttcatggactgtaatagaattccaacatcagattgccgttgccggagaattggaacacgcattagaagcaatcaaatggggaactgattatttcatcaaggcacatactagcccgaatgtgctatgggcagaggtgggtgacggtgacaccgaccactattgctggcaacggccggaggacatgaccacatcacggcaagcttacaggatcgacgagaataatcccgggtcagatcttgctggagaaaccgcggcggcaatggcggcggcatcaatagtgttcaagaaaacaaaccctcattactctcacctgctcttgcaccatgcccaacagttgtttgagtttggagacaagtatagaggtaaatatgatgaaaatatgggtgtggtgaaaagctactatgcgtcggtgagtggatacaaagacgaattgctatggggagctctgtggctgtacaaggccaccgacaatgaaaagtatctcgagtacgtcattaacaatgctcattgttttggcgggactggttgggccatggaagaattcagctgggatgtgaagtatgctggccttcaaattatggctgcaaagttgctcgtggaagaaaagcacagggaacatggcgacacgttggaacaataccgatcaaaagccgagcactacctatgctcatgccttaacaaaaacaacggtaccaatgtgaatcgtaccccaggtggtctattgcacatccggcaatggaacaacatgcagtatgtctcaacggcagcattccttctcactgtatactccgatttccttctaaactcgaatcaaaagctcaaatgccatggtggatctgtggatcacgaagagatcctcggttttgctaaatctcaggttgattacatcctaggttcaaacccaatgaacatgagttatttagtgggatacggccctaaataccccgcaagagtgcaccatagaggggcctcaattgtgtcatacagagagaacaaggggttcattgggtgcacccaagggtacgacaattggtatggccgggaggagcctaacccaaatgttttagtcggagcattggtcggaggacctgattgtcaggataacttcacggaccagagaagcaattacatgcagactgaggcctgcacatacaatacagcaccactagttggagtttttgccaagttattacaaatggagggccaaaag

SEQ ID NO: 371 - protein, 410 aa, Arabidopsis thaliana
MAKRQLLMLGIRTSFHTIAAVLVAGLIFTAVFLSRNSLPKENPQSHGVTDRGGDSGRECNLFEGKWVFDNVSYPLYKEEDCKFMSDQLACEKFGRKDLSYKFWRWQPHTCDLPRFNGTKLLERLRNKRMVYVGDSLNRGQWVSMVCMVSSVITNPKAMYMHNNGSNLITFKALEYNATIDYYWAPLLVESNSDDPTNHRFPDRIVRIQSIEKHARHWTNSDIIVFNSYLWWRMPHIKSLWGSFEKLDGIYKEVEMVRVYEMALQTLSQWLEVHVNPNITKLFFMSMSPTHERAEEWGGILNQNCYGEASLIDKEGYTGRGSDPKMMRVLENVLDGLKNRGLNMQMINITQLSEYRKEGHPSIYRKQWGTVKENEISNPSSNADCIHWCLPGVPDVWNELLYAYILDHHSS

SEQ ID NO: 372 - DNA, 1538 bp, Arabidopsis thaliana
gtcaacacaaaaagttttagaatttatattaggaaaatgattcataaatgtatatatagacagctacagaaaattgattgaccaccaaacaacaaaataacttcaagaaggctggagttaaaaggcaagtaagagaaagacacatcaatataacccaaaacaaaacatcataacagcaacaataacagacacataaccaatggcaaagcgacaactgttgatgctgggtattagaactagctttcatactatcgccgccgtgcttgtggccggattaatattcactgccgtgtttttgtccagaaacagtttgccaaaggaaaatcctcaaagccacggtgttacggatcgcggaggggacagtggcagagaatgtaatttgttcgaagggaaatgggtatttgataacgtatcataccctctttataaagaagaagattgcaagttcatgtctgaccagttggcttgtgagaagtttgggaggaaagatctgagttacaaattctggaggtggcaacctcacacgtgtgatcttcccaggtttaatggaacgaagttgctggagaggctaagaaataagaggatggtgtacgtaggagactctctgaacagaggccaatgggtatcaatggtgtgtatggttagttcggtaattacaaacccaaaggcgatgtatatgcacaacaatggctctaacctcatcacgttcaaagctctcgaatacaatgctacaatagactactattgggctcctttgctggtggaatccaactcggacgacccgacaaaccatagattccccgatcggatagttcggatccaatcaatagaaaaacatgcaaggcattggacgaactctgatatcattgttttcaactcttacttatggtggagaatgcctcatatcaagtcactgtggggatcgtttgagaaattagatggaatatacaaggaagtggagatggtgagagtttatgaaatggctttgcaaacactgtctcagtggttggaggttcacgttaaccccaatattaccaaacttttcttcatgtccatgtctcccacccatgaaagggctgaagaatggggaggaatacttaatcagaactgttatggagaagctagtctaatagataaagaaggatatactggaagagggtcagatccaaagatgatgagagtcttagaaaatgtgcttgacgggctaaaaaatcgaggattaaacatgcagatgataaacattacgcaactatcagagtatcgaaaagaaggtcatccttcgatctacagaaaacaatggggaacagtgaaggaaaatgaaatctcgaatccaagtagtaacgcagattgtatacattggtgtttgcctggagttcctgatgtttggaatgaactcctttatgcttatattcttgaccatcattctagttgaaaactactattatatcttttgtttttttacctattccacttcaattgtacagttgatttccttactctcacttcttttctatcaaaaaaattaacatgtttttctt

SEQ ID NO: 373 - protein, 449 aa, Arabidopsis thaliana
MSQRWSRKKSRLPLAGLLFILVVTFMILFNERSIQQIHHHAASHTQNLREPSTFDFVKPNVPRINYLGAHEVLDRFSKCNSTKEYSGKKIGWVDPFEDHPGQVTKEEQKCDVFSGKWVFDNSSSYPLHKESQCPYMSDQLACQKHGRKDLEYQHWRWQPHACNLKRWNAIEMWEKLRGKRLMFVGDSLNRGQWISMVCLLQSVIPRDKQSMSPNAHLTIFRAEDYNATVEFLWAPLLVESNSDDPVNHRLSERIIRPDSVLKHASKWQHADILIFNTYLWWRQDSVKLRWSSEEKGSCEEVKSAEGMEMAMDSWGDWVANNVDPNKKRVFFVTMSPTHQWSREWNPGSEGNCYGEKKPIEEESYWGSGSDIPTMRMVKRVLERLGPKVSVINITQLSEYRKDGHPSVYRKFWEPLNEDRLKNPASYSDCTHWCVPGVPDVWNQLLFHFL

SEQ ID NO: 374 - DNA, 1557 bp, Arabidopsis thaliana
attaatctctctctgcctctactcactggatcatcatagctccaaacttgtaccagtcgcatcaaagcaagttttggtgaagaagaagagacgaggtcttcctcttactgtggtggtgacattttctctaaaaagaaagtctccgatatgtcgcagagatggagtagaaagaagagtagacttccattagcgggtctcctctttattctcgttgtcacctttatgattctcttcaacgagcgtagcattcagcagatccatcaccacgccgcgagtcacactcaaaatctccgagaaccttccacgttcgatttcgtcaagcctaatgttcctcggattaactacttgggagctcatgaggttttggatagattcagcaaatgcaactcgacgaaagagtacagtgggaagaaaatcggatgggttgacccgtttgaagaccacccgggtcaagtaacaaaggaggagcagaaatgtgatgtcttttctgggaaatgggtctttgataattcatcatcataccctttacacaaggaatctcagtgtccttacatgtccgaccagttggcttgtcagaagcatggtaggaaggatttggagtatcagcattggagatggcaacctcatgcctgcaacttgaagagatggaatgcgatagaaatgtgggagaagctgagaggaaagagattgatgtttgttggagactcgttaaacagaggccaatggatttcaatggtttgtctcttacagtctgtcattccacgtgacaagcagtctatgtctcctaacgctcacctcaccattttcagggctgaggactacaatgccacagtggagtttctctgggcaccgttgctcgtggagtcgaattctgatgaccctgttaatcacagattgagcgagcggattatccgacccgattctgttcttaaacatgcatcaaagtggcaacatgctgatattctaatcttcaacacctacttatggtggagacaagactctgtcaagctccgatggagcagtgaagaaaaagggtcatgcgaggaggtgaagagcgccgagggaatggagatggcaatggatagttggggtgattgggttgctaacaatgtcgatccaaacaaaaagcgagttttcttcgttacaatgtctcctacacatcaatggagccgagaatggaacccgggaagcgaaggaaactgctacggggagaagaaaccaatagaggaagagagttattggggaagtgggtcggacattccgacaatgaggatggtgaagagagttttggagagattgggaccaaaggtctcagttataaacatcactcagttgtctgagtatcgaaaagatggtcatccatcggtgtaccggaaattctgggaacctctaaatgaagaccggttgaaaaacccggcatcgtattctgactgtactcattggtgtgtacctggagttcctgatgtctggaatcaattgcttttccattttttgtgaaaatgaaatgaatataaccttaccttgatggccgaatatcacccataaattatataacgg

SEQ ID NO: 375 - protein, 410 aa, Medicago truncatula
MQMAIKEHQILVLHTNLGIRITFHSLVAFLTTILVVTAIYLTQEGGQWSLEKTITSESMSKCNLFDGEWVFDNESYPLYKEQQCKFMSDQLACEKFGREDLSYQNWRWKPHQCDLPRFNATTLLERLRNKRLVFVGDSLNRGQWVSMVCLVESSIPSSLKSMQTIANGSLNIFKAKEYNATIEFYWAPLLVESNSDDPVNHKVPDRTVRVQAIEKHAKYWTDADIIVFNTFLWWRRKAMNVLWGSFGSPNGVYKKVAMVRVYEMALRTWSDWLEVHINRNKTQLFFVSMSPTHQRAHEWGGAKGENCYKERDQIKEEGYSGNGSVPKMMQVVENVLQDLKRRGLNVQLLNITQLSEYRKEGHPSIYRKQWEPLTEEQISNPKSYADCIHWCLPGVPDTWNELLYAYIFHR

SEQ ID NO: 376 - DNA, 1233 bp, Medicago truncatula
atgcaaatggcaattaaggaacaccaaatactagtgttacacaccaatttgggaatcagaatcacttttcattctcttgtagcatttttaacaactattctagttgtcactgccatatatctaacacaagaaggaggacaatggtctcttgaaaagactatcacttctgaatcaatgtcaaaatgtaacttgttcgatggtgagtgggtttttgacaatgaatcttatccactctacaaagaacaacagtgcaagttcatgtctgatcaactggcttgtgagaagtttggaagggaggatcttagctaccagaattggaggtggaagcctcatcaatgtgacctaccaaggttcaatgccacaacattgcttgaaaggctaaggaacaagaggcttgtgtttgttggggattcactcaacagaggacaatgggtttcaatggtttgccttgttgaatcttcaattccctcaagtctcaaatccatgcaaaccattgccaatggttcactcaacattttcaaggccaaagaatacaatgcaaccatcgagttctattgggccccattacttgtagaatcaaattcagatgatccagtgaaccataaggtgccagataggactgtgagagttcaagccattgagaaacatgctaagtattggactgatgctgatattatagtcttcaacacattcctttggtggagaaggaaagcaatgaatgttttgtgggggtcatttggaagccctaatggagtatacaaaaaggtagcaatggttagagtctatgaaatggccttgagaacatggtctgattggttggaagtccatattaatcgtaacaagacccaattgttttttgtttctatgtcacctactcaccaaagggctcatgaatggggaggagcaaagggtgaaaattgttacaaagaaagagatcaaattaaagaagagggatatagtggaaatggttctgttcctaaaatgatgcaagtggtggaaaatgttctacaagatttgaaaagaagaggtttgaatgttcaattgcttaacataacacaactctcagagtacagaaaagaaggtcatccatctatctataggaagcaatgggagcctctaacagaagagcaaatatcaaatccaaaatcttatgcagattgcatacattggtgtctccctggtgtgcctgatacttggaatgagcttctttatgcctatattttccatagatga

SEQ ID NO: 377 - protein, 503 aa, Oryza sativa
MWSALFSHLREVHKRSGVKEEKLIMKSPAAAGEAAGCHKPQATATNKMTVLQSPLGLRTILTSLVAFFIVVSSVSLLFDRSQDAQAQLAVAQHQHQEVQLKQKPASAAVGEQKSVFVDQSSLRSQEAQVQWTSELQDVATDSGDGGVDGEEECNWSLGRWVYDNSSRPLYSGLKCSFIFDEVACDKYGRNDTKYQHWRWQPHGCNLPRFNATKFLEKLRNKRLVFVGDSVNRNQWVSMVCMVEHFIPDGRKMRVYNGSLISFKAFEYNATIDFYWSPLLLESNSDNPIIHRVEYRIIRADRIEKHANVWKDADFIVFNSYLWWRKQRDGMTMKVMYGSFEDGDAKLDEVEMVDGYEIALKKLTEYLGANINKNKTRIFFAGSSPAHSWASNWGGDDNNKCLNETEPIQIEDYRSATTDYGMMDKAKEIFGTLEPKGIHVQILNITQLSEYRKDAHPTIFRRQYVPLTKEQIANPSIYADCTHWCLPGVPDVWNEFLYAYLMHK

SEQ ID NO: 378 - DNA, 1796 bp, Oryza sativa
aagggtcagtgttgcttgagaggtactcactctgtgcaggtgccagtggactcagggcatttagctagccagccaaagccaattgccatgtggagtgctctcttctcccatctgagagaggttcacaagagaagcggagttaaggaggagaagttgataatgaagtcgccagcagcagcaggtgaggccgccggctgccacaagccgcaggcgactgccaccaacaagatgacggtgctgcagtccccgctggggctcaggaccatcctcacctccctcgtcgccttcttcatcgtcgtcagctccgtctccctcctcttcgaccgcagccaggatgctcaggcgcagctcgccgtcgcgcagcatcagcaccaagaagtccagctcaagcagaagccggcatcagcagcagtgggcgagcagaaatcagtattcgtagatcagtcgtcgctgaggagccaggaggcgcaggtgcagtggacatctgagctgcaggacgtggccacggacagcggcgacggcggcgtcgacggcgaggaggagtgcaactggtcgttgggacggtgggtgtacgacaactcgtcgcggccactttactccggcttgaagtgctcctttatcttcgacgaggtagcctgcgacaagtatggaaggaatgacaccaagtaccagcactggagatggcagcctcacggttgcaaccttccaagattcaatgccacaaagtttcttgaaaagcttaggaacaagagactagtttttgtgggcgattcagtaaacagaaatcaatgggtgtcgatggtgtgcatggtggagcacttcatccctgatggccgcaagatgcgcgtttacaacggctcccttatctccttcaaagcatttgagtacaatgcgacgatagatttctactggtcaccactgctattggaatcaaacagcgacaaccccataattcacagagtggagtatcggatcataagggcagacaggattgagaaacacgccaatgtctggaaggacgctgatttcatcgtcttcaactcctacctttggtggaggaagcagagggatggtatgacgatgaaagtcatgtatggttcatttgaggatggggatgcaaagttagatgaggtggaaatggttgatggttatgagatagctctcaagaaactaactgaatatcttggagccaatatcaacaagaacaagactagaatcttctttgcaggctcatcacctgcccattcctgggctagcaactggggaggagatgacaacaacaagtgtctaaacgaaacagaaccaattcagatagaagattataggagtgcaaccacagactacggcatgatggacaaggcgaaggagatctttggaacattggaaccaaagggcatacatgttcagatactgaacatcacccagctttctgagtaccgcaaggacgcccatccaacgatattcaggagacagtacgttcctctgacgaaagagcagattgcaaacccgagcatctacgcagactgcacgcattggtgcctccctggagttcctgatgtctggaacgagttcttgtatgcgtacctcatgcacaaatgatatatgtataataatgtaaccttaatttggccaaatttcttctttgttaacttgtgggtgtctaagtaggtataagtgcacagtacttggcccccatcaattttttctgtttttgacatttacatcattacatgtaaagagaaagggaagaacataatcgcagaaatgaaaaggaagaagataagttgatttgccta

SEQ ID NO: 379 - protein, 502 aa, Oryza sativa
MWSALFSHLREVHKRSGVKEEKLIMKSPPAAGEAGCHKPQATATNKMTVLQSPLGLRTILTSLVAFFIVVSSVSLLFDRGQDAQAQLAVEQHQHQEVLLKQKPASAAVGEQKSVVVDQSSLRSQEAQVQWTSELQDVATDSGDGGFDGEEDCNWSLGRWVYDNASRPLYSGLKCSFIFDEVACDKYGRNDTKYQHWRWQPHGCNLPRFNATKFLEKLRNKRLVFVGDSVNRNQWVSMVCMVEHFIPDGRKMRVYNGSLISFKAFEYNATIDFYWSPLLLESNSDNPIIHRVEYRIIRADRIEKHANVWKDADFIVFNSYLWWRKQRDGMMMKVMYGSFEDGDAKLDEVQMVDGYEIALKKLTEYLGANINKNKTRIFFAGSSPAHSWASNWGGDDNNKCLNETEPIQIEDYRSATTDYGMMDKAKEIFGTLEPKGIHVQILNITQLSEYRKDAHPTIFRRQYVPLTKEQIANPSIYADCTHWCLPGVPDVWNEFLYAYIMHK

SEQ ID NO: 380 - DNA, 1860 bp, Oryza sativa
acacaaccattccaattctattctaacccatttataagctccttcattggaggttagcccaagggtcagtgttgcttgagaggtactcaccctgtgcaggtgccagtggactcaggccatttagctagctagccaaagccaattgccatgtggagtgctctcttctcccatctgagagaggttcacaagagaagcggagttaaggaggagaagttgataatgaagtcgccaccagcagcaggtgaggccggctgccacaagccacaggcgactgccaccaacaagatgacggtgctgcagtccccgctggggctcaggaccatcctcacctccctcgtcgccttcttcatcgtcgtcagctccgtctccctcctcttcgaccgcggccaggatgctcaggcgcaactcgccgtcgagcagcatcagcaccaagaagttctgctcaagcagaagccggcatcagcagcagtgggcgagcagaaatcagtggtagtagatcagtcgtcgttgaggagccaggaggcgcaggtgcagtggacatctgagctgcaggacgtggccacggacagcggcgacggcggcttcgacggcgaggaggactgcaactggtcgttgggacggtgggtgtacgacaacgcgtcgcggccactctactccggcttgaagtgctccttcatcttcgacgaggtggcctgcgacaagtatggaaggaatgacaccaagtaccagcactggagatggcagcctcacggttgcaaccttccaagattcaatgccacaaagtttcttgaaaagcttaggaacaagagactggtttttgtgggcgattcagtaaacagaaatcaatgggtgtcgatggtgtgcatggtggagcacttcatccctgatggccgcaagatgcgcgtttacaacggctcccttatctccttcaaagcatttgagtacaatgcgacgatagatttctactggtcaccactgctattggaatcaaacagcgacaaccccataattcacagagtggagtaccggatcataagggcagacaggattgagaaacacgccaatgtctggaaggacgctgatttcatcgtcttcaactcctacctttggtggaggaagcagagggatggtatgatgatgaaagtcatgtatggttcatttgaggacggggatgcaaagttagatgaggtgcaaatggttgatggttatgagatagctctcaagaaactaactgaatatcttggagccaatatcaacaagaacaagactagaatcttctttgcaggctcatcacctgcccattcctgggctagcaactggggaggagatgacaacaacaagtgtctaaacgaaacagaaccaattcagatagaagattataggagtgcaaccacagactacggcatgatggacaaggcgaaggagatatttggaacactggaaccaaagggcatacatgttcagatactgaacatcacccagctttctgagtaccgcaaggacgcccatccaacgatattcaggagacagtacgttcctctgacgaaagagcagattgcaaacccgagcatctacgcagactgcacgcattggtgcctccctggagttcctgatgtttggaacgagttcttgtatgcatacattatgcacaaatgatatatgtataataatgtaatcttaatttggccaaatttcttctttgttaacttgtgggtgtctaagtaggtataagtgcacagtacttggcccccatcaatttttttttcttttttgacatttacatcattacattacatgtaaagagaaagggaagaacataagcgcagaaatgaaaaggaagaagataagttaatttgccta

SEQ ID NO: 381 - protein, 402 aa, Populus trichocarpa
MVPATWGIRSSFHSLIALLVAFLVIASIYVTQNSGVLVEDRTKSKSSGDLLSRCNLFSGKWVFDNKSYPLYKEKECTFMSDQLACEKFGRKDLNYQNWRWQPHQCDLPRFNATVLLERLRNRRLMFVGDSLNRGQWVSMVCLVDSVIPPGLQSMHQYRNGSLHIYKATEYNATIEFYWSPLLVESNSDDPVYHRVDDRTVRVQGIEKHARHWTDADILVFNTYLWWRRAQMTVMWGSFERPDGIYKRVQMPRVYEMALKTWSDWLEVHVNRTKTQMFFISMSPTHEKALEWGGDEGQNCYSETEPIFKEGYRGEASCPEIMRVVEKTLDDLKTRGLNVQMINITQLSDYRKEGHQSIYRKQWEPLKEEQISKPSSYADCIHWCLPGVPDVWNELLYAHIINL

SEQ ID NO: 382 - DNA, 1209 bp, Populus trichocarpa
atggttccagcgacatgggggatcagaagcagcttccattcccttattgcacttcttgtcgcgttcctagtcatagcttccatctatgtaacccagaatagtggtgtgctcgtagaagataggactaagagtaagagctctggtgatttgctgtcaaggtgcaatttgttctcaggaaaatgggtttttgataacaaatcttaccctctgtacaaagagaaagaatgcaccttcatgtctgatcagttggcttgtgagaagtttgggagaaaggacttgaactatcagaactggaggtggcaaccacaccagtgtgaccttcctaggttcaatgccacagtattgctagaaaggctaaggaacaggaggcttatgtttgtaggggactcattaaacagaggccaatgggtttcaatggtctgtctcgtggactcggtgattcctccagggctccaatccatgcatcagtaccgcaatggttcattgcacatctacaaagccactgaatataatgcaacaattgagttctattggtctcctttactggtggaatcaaattctgatgatccggtataccaccgagtagatgatcggactgttagagttcaaggcattgaaaagcatgcgaggcattggactgatgctgacattcttgtttttaatacctatctttggtggagaagagcccaaatgactgtcatgtggggatcatttgaaaggccagatggaatttacaagagagtacagatgccaagagtttatgagatggctttaaagacatggtcagattggctagaggttcatgtaaaccgaaccaaaacacaaatgttcttcatcagcatgtcaccaactcatgaaaaggctttagagtggggtggcgatgaagggcaaaattgttacagcgagacagaaccgatcttcaaagaaggatacagaggagaggcctcctgcccagaaatcatgcgtgtggttgagaagactcttgatgacttgaaaacaagaggattaaatgtacaaatgattaacattacacagttatcagattacagaaaagaaggccatcaatcgatatatagaaagcaatgggagccattaaaggaagaacaaatatcaaaacccagcagctatgcagactgtatacattggtgtctccctggagttccagatgtgtggaatgaacttctttatgctcacattattaatctttga

SEQ ID NO: 383 - protein, 416 aa, Arabidopsis thaliana
MGLNEQQNVPSQRKIIVFIVLAFIPIALFRLCFNNPFSSIKDTSLQDSAANVVITSFSSSSQEEESQESFDHIQDEPLCDYTQGNWVRDEIGPLYNGSTCGTIKDGQNCFRHGRPDSGYLYWKWKPNECDIPRFDSNRFLDLMRDKHLAFIGDSMARNQLESLLCLLSTVSSPDLVYRNGEDNKFRRWRFESHNVTVSVYWSPFLVAGLEKSGNLDHNVLHIDRVDERWGNDLERFDTVVVSVGHWFLHPAVYYESGSVLGCHSCETSNCTEVGFYDVFRKAIRTTLRAVAGSGREVILTTFSPSHFEGRPWDSLGACNMTKPYEGKVLEGLDLDMRKIEIEEYTAAAAEVRLEVLDVTAMSVLRPDGHPGPYMYADPFKNGVPERIPNDCLHWCLPGPVDTWNEIMIEMLRRWKV

SEQ ID NO: 384 - DNA, 1541 bp, Arabidopsis thaliana
caataatcaaaaacacgaaagccaaaataaaagagagaaaaagaagataagttgttctatgttcctgaaatgggattaaacgagcaacaaaatgttccaagtcagaggaagatcatagtttttatagtcttagcttttataccaatagctctgtttcgactctgttttaataatccattctcctccattaaagacacctctcttcaagactctgcagctaacgttgtgatcactagcttctcttcatcttctcaagaagaagaaagccaagagagttttgatcatatacaagatgaacctttatgcgattatacgcaagggaactgggtcagagacgagattggtccactctacaatggttcaacatgtggaacaatcaaggatggtcagaattgtttccgccatggtagacctgattccggttatctttactggaaatggaaaccaaacgaatgcgatataccgagattcgactcgaaccggtttcttgatcttatgagagataagcatctagcttttatcggtgattccatggctagaaatcagcttgagtctcttttatgcttgctctctaccgtctctagccctgatctcgtctatagaaacggagaagacaataaattcagaagatggcgtttcgagtcacacaacgtcactgtctcggtttactggtccccgtttttggtggccggtttagagaaatcgggaaacttggaccacaatgtattgcacatagaccgcgtggatgagagatggggcaatgatttagaacgttttgatacggtcgtagtctctgtgggacattggtttctgcatccagcggtttactacgagtctggttcggttttgggatgtcattcttgtgaaacaagtaactgtaccgaggtagggttttatgatgtatttagaaaagcgataagaacaacgttgagagcggttgctggaagtggtcgtgaggtgatcttgacgacattttcgccatcacattttgaaggacggccttgggacagtctcggcgcatgtaacatgaccaagccgtacgaagggaaggttttagaaggtctggacttggacatgcgcaaaatagaaattgaggaatatacggcggctgcggctgaggtgaggttagaggtgttggacgtgacggctatgtcggtactgagaccagacggacatcctggtccgtacatgtacgcggacccgttcaagaacggtgtaccggagagaattcctaatgattgtttgcattggtgtctacctggtcctgtcgacacgtggaacgagatcatgatcgagatgttgcggcgatggaaggtttaaatgatgaacattgattgttgaagatcctatgatatcattcatttacacgcatatgacaaaagaacaaaatgtgtaataattttttgggatttcaaaaagtagctaggtagtttattttcttggattagatacgaaaaaaacagacatggatgatactcttttttgttggttatttcttccgttcttcaaaccatggaggagtacaaaaaatagttgaacat

SEQ ID NO: 385 - protein, 468 aa, Oryza sativa
MVTTNFVQNHHLQNSQFFLLPKRQLVTYALYALIPLALLHYLLFNPVATAKKPVVVVVQATDDASVIASSHHEHVKVNAKQLPVPPSDQGDEGFKKNAIAGEVAAAAACDYSDGEWVPDARPPLYNGTSCATIKDGQNCMAHGRPDTGYLHWRWRPRRCDLPAFSPEAFLGWLRGKHLAFVGDSLARNQAESLVCLLASRSTPELVHRDGEENRFRRWAFREHDATVSIFWSPFLVKAAEKAERAGVRHNNVFLDAFDERWMSGLGGLDAVVLSIGHWFLIPGIYHDAGEVVGCHDCAEFNHTETPFFAVFRQAVHRTLAEITRRHVLAAGAGTSKSKSKVVAFTTFSPAHFEGEWDKAGACNKTRPYKNGEKEAGYTEAEMRKTVVEEVAAADAAAAGGGGAGLRFAALDVTTLANLRPDGHPGPYMRGDPFAGGGGGARVQNDCVHWCLPGAIDTFNEILLQTITR

SEQ ID NO: 386 - DNA, 1802 bp, Oryza sativa
ttttcttttttactccccaatcccccttcttcctccttgatccctttcttctccccatccctctttgccatggtttccgcatcttgagctgagcagagcacagcttgtacctgcagccagccatggtgaccaccaatttcgtgcagaaccaccaccttcagaacagccagttcttcctgctccccaagaggcagcttgtgacctacgccctctacgctctcatccctctcgccctcctccattaccttctcttcaaccctgtggccactgccaagaagccggtggtggtggtggttcaggcgacagacgatgcttcggtcatcgcctcgtctcatcacgagcatgtcaaggtgaatgccaagcagctgcctgtgcccccttctgaccaaggagatgaagggttcaagaagaatgcgatagccggagaagtggcggcggcggcggcgtgcgactactccgacggcgagtgggtgccggacgcgcggccgcctctctacaacgggacgagctgcgccacgatcaaggatgggcagaactgcatggcgcacggccggccggacaccggctacctccactggcggtggcggccgcggcggtgcgacctcccggcgttctcgccggaggcgttcctcggctggctccgcggcaagcacctcgcgttcgtcggcgactcgctggcgcgcaaccaggcggagtcgctggtgtgcctcctggcgtcccgctccacgccggagctcgtgcaccgcgacggcgaggagaacaggttccggcggtgggcgttccgggagcacgacgccaccgtgtccatcttctggtcgccgttcctcgtcaaggccgcggagaaggcggagcgcgccggcgtgcggcacaacaacgtgttcctggacgcgttcgacgagcggtggatgtccgggctggggggcctcgacgccgtcgtgctctccatcgggcactggttcctgatcccgggcatctaccacgacgccggcgaggtcgtcggctgccacgactgcgccgagttcaaccacaccgagacccccttcttcgccgtgttcaggcaggcggtccaccggacgctcgccgagatcacccggcgccacgtcctcgccgccggcgcgggcacgagcaagagcaagagcaaggtggtggcgttcacgacgttctcgccggcgcacttcgagggggagtgggacaaggccggcgcgtgcaacaagacgcggccgtacaagaacggcgagaaggaggccgggtacacggaggcggagatgcgcaagaccgtcgtggaagaggtcgccgccgccgacgccgccgcggccggcggcggcggcgcgggcctgcggttcgcggcgctggacgtgacgacgctggccaacctgcggcccgacgggcacccgggcccgtacatgcgcggcgacccgttcgccggcggcggcggcggcgcgcgggtgcagaacgactgcgtgcactggtgcctccccggcgccatcgacacgttcaacgagattctgctccagaccatcaccagatgacgacgttgataagatgaatcgtttcgtctcgtttacgagatcatacgagtagatagtgcgaattccgcggtaaaaatggtttggtttagatctcagtgatttttgggtgtcgcctttgatgtagctgtaattgttagagcatatacaatagcaggctataagtccgttataaacataagtccgttataaacatattttaaagagatatatgaaaagataggagagcagcgggctacagatctgtagccagctgcagcatgggaattggctatt

SEQ ID NO: 387 - protein, 240 aa, Arabidopsis thaliana
MTKLAIIPFTVLLETLFLNKKFSQKIKFSLFLLLVGVGIASITDLQLNFVGSVLSLLAIATTCVGQILTNTIQKRLNVTSTQLLYQSAPFQAAILFVSGPFVDKYLTSLNVFSFHYSPIVVGFITLSCLIAVSVNFSTFLVIGKTSPVTYQVLGHLKTCLVLAFGYTLLHDPFTPRNIAGILIAVLGMLLYSYFCSVASKSKQASSDSTFLGKDRDTTPLLGQENENHHEAKKLDKHSPV

SEQ ID NO: 388 - DNA, 908 bp, Arabidopsis thaliana
tccattggtctcctcaatctcagcctcggctttaattccatcggcttctatcaaatgaccaaacttgctatcataccattcactgttcttttagaaaccctcttcctcaacaagaagttcagccagaagataaaattctcattgtttttgctgctagttggggttggtatagcatcaatcacagatcttcagctcaattttgttggctctgttctatctctccttgccattgccacaacttgcgtcggccaaattctaacaaacactatccagaagagactgaacgtgacatcaacacaactcctataccaatcagccccgttccaagctgctatactcttcgtctcgggtccttttgtcgacaaatacctcactagcctcaatgttttctccttccattactctcccatcgtcgtggggttcataacgttgtcgtgtttgatagcggtttcggttaacttcagtacgtttttagtgattggaaagacatctccggtgacataccaagtcttgggacatctcaaaacgtgtttggtgctcgcatttggttacactctccttcacgatcccttcactcctcgtaatatcgcaggaatactcatcgctgtcctcgggatgcttctctactcctacttctgctcagttgcttctaaatccaaacaagcctcctccgattccacttttcttgggaaagatagagatacgacgccgcttttgggacaagaaaatgagaaccatcatgaagccaagaaattagacaagcattctccagtatgaaatagtacaataactctttctttatgtttcgactctataattgtgtcccttttttttgttcattcattgataatgtttttgtaattgagaaaaaattgaaatagccaatgggcattttctcttctttttta

SEQ ID NO: 389 - protein, 341 aa, Oryza sativa
MTAGFQLGVIGSLTLSVASSVSIVICNKALISTLGFPFATTLTSWHLMVTFCTLHVAQRMRFFEPKAIDGQTVILFGLLNGTSIGLLNLSLGFNSIGFYQMTKLAIIPFTVMLETIFLKKRFSESIKFSLLILLLGVGIASVTDLKLNLLGSVLSGLAIATTCVGQILTNTIQKRLKVSSTQLLYQSAPYQAAILFATGPFVDQLLTSRSVFAHKYTAPVVGFIVLSCLIAVSVNFSTFLVIGTTSPVTYQVLGHLKTCLVLSFGYTLLHDPFTMRNILGILVAIFGMALYSYFSVRESKKKSAGDPLPVSQMPEKEVEPLLATKDVNGDTKKANGVTHDC

SEQ ID NO: 390 - DNA, 1675 bp, Oryza sativa
gtggtacctcgacataaaaatgcctctccctctccctcccttcttcatcttcctccgtccactccggggcgccattgcctagaattgatcaattgatactgcaatcaaggaagaacaccatagctgcagaggtacttatgtaggttgctgttcaggaggaggaggaggaggaggcgatctctgtacattttgaaggatttttgaagttcagtcttcagactaaaagagacacaggtggccaagatgactgctggtttccagcttggtgtgatcggatcactgacgctctcagtggcatcatcggtttccattgtcatctgcaacaaagctctcatcagcactctcggatttccatttgctactacattaacaagctggcatctcatggtgaccttctgcacccttcatgtcgcacaacgtatgcgcttttttgaaccgaaagcgatcgatgggcaaactgtaatcctatttgggttgctgaatgggacatcaataggccttctcaacctcagtttaggattcaattccattggattctaccagatgacaaagttggccatcatacccttcacagtaatgttggagaccatcttcttaaagaaaagattcagtgagagtatcaagttttctctgctgatcctgctacttggagttggcattgcttctgtcactgacctcaagttaaatcttcttgggtctgtcctttctggcctcgccatcgccacaacttgtgttggccaaattctcaccaacacaatacagaagaggttaaaggtctcttcgacgcagcttctgtatcaatccgcgccttaccaagcggcgatcctgttcgcaaccggccccttcgtggatcagctcctcaccagccgcagtgtcttcgcccacaaatacacggctccagtcgtgggtttcatcgttctgtcctgcctgatcgcggtgtccgtgaacttcagcacgttccttgtgatcgggacgacgtcgccggtgacgtaccaggtgctgggccacctcaagacgtgcctggtcctgtcgttcgggtacacgctgctgcatgaccccttcaccatgaggaacattctgggcatcctcgtcgccatattcgggatggcgctctactcctacttctcggtccgggagagcaagaagaagtcggcaggcgacccacttcccgtgtcgcagatgccggagaaggaggtggagccgctcctggcgaccaaagacgtcaacggtgacaccaagaaggcgaacggcgtgacccacgactgttgaatatatgtgtctcatttgttttagcatttagcccagcatttagctgtgtagcaccggcacacgtaagcctacccgttgtatctgaaattctgaatggccggggaacccgttcctttccatttgtcgatttcttgcgctttgtaagaagcggagtacctgtcgtcggagccggtacaggcagcagcccaaaaaactcgaggcccccggcaccacgagacgtacgagactgctccggcccctgcttctggatggatgatacgcaaagccccgtgtaagaaaaagtccatttggagtccctcatattggccgaatttctattaaaaaattcattggccgaacttaatttgaatctctcatcgcaaaacaggctatgtcgccaatagcttattatttttgttttggaaat

SEQ ID NO: 391 - protein, 342 aa, Oryza sativa
MMMSSGFQLGVIGSLALSVASSVAIVICNKALISTLGFPFATTLTSWHLMMTFCTLHVAQRLHFFEPKAIDGQTVILFGLLNGTSIGLLNLSLGFNSIGFYQMTKLAIIPFTVLLETIFLKKRFSESIKLSLLVLLLGVGIASVTDLKLNLLGSVLSGLAIATTCVGQILTNTIQKRLKVSSTQLLYQSAPYQAAILFATGPFVDQLLTNRSVFAHKYTTPVLGFIMLSCLIAVSVNFSTFLVIGTTSPVTYQVLGHLKTCLVLSFGYILLHDPFNARNILGILIAIFGMGLYSYFSVKEGKKKATNDPLPVSQMPEKETEPLLATKDNSDTKKANGVSHDC

SEQ ID NO: 392 - DNA, 1699 bp, Oryza sativa
atatgatgcctaccatacacaaaaattttggacataaaaactgcttctccctccctccctcccttcctctctctaccataccaaggagagccatagcctctctctctctctctctctctagatatctctctctttttctctctagatctctcttttttcttgtatctctataggttgttagagcggcgacggcgagaagaggaaggagcaacaaggagtagatcatcagtatagagagcagcagcaatttgggaaggttcattattacagctctgttgtttcatttctttgaggagacgaagttagcaagcagggattgctgtttctgaatttcaaggagaagataacaatagcaaatgatgatgtcatctgggttccagctcggtgtgatcgggtctcttgcgctgtcggttgcatcatcagttgccattgtcatctgcaacaaagctctcatcagtacccttggtttccctttcgctacaacattgacaagctggcatctcatgatgaccttctgcaccctccatgtggcacaacgcttgcatttctttgaaccaaaggcaattgatgggcaaacagtgatcctctttgggttgctgaatggcacctcaattggccttctcaaccttagtttaggattcaactccattggattctaccagatgacaaaattggcgatcatacctttcactgtgctgttggagacaatcttcctgaagaaaagattcagcgagagtatcaagctttctctactggtcttacttcttggagtgggcattgcttcagttactgatctcaagctaaatctacttggatccgtcctttctggactcgccatcgcgaccacttgtgttgggcaaattctcacaaatacaatacagaagagattgaaggtatcctcaacgcagttactctaccaatctgcaccttaccaggcagcaattttgtttgcgactggcccttttgtagatcaactccttacgaaccgcagtgtcttcgcccacaagtacaccactccagttttgggtttcatcatgctatcttgtttgattgcggtgtctgtgaacttcagcacatttcttgtgattggaacaacatctccagttacataccaggtgctaggccaccttaagacatgtctcgttctctcatttggatacattctgttacacgatcctttcaacgcaaggaacatattaggaattttgatcgccatatttgggatgggattgtactcctacttctcagtgaaggagggcaagaagaaggcaacaaatgatccactgccagtttcacagatgccagaaaaggagactgaaccacttttggcaaccaaagacaacagtgataccaaaaaagcaaatggtgtatctcatgactgctaagacttctcttgcttagtgtagatctagtatatgcacactgcatgcctgctcgttgaatttgaaggacctggaaagccatttctttccattcttgattgttttgtagaaaagataaatgagttttatacttgtagagagtgtatattttgacattaaaattatcatttgatcctactttcatattcaacagttccaactgagggtttacagtgccttgcagatcaccttgtcgatacactctcatgtttattgaaacaggacctacttccttccaacatagggcatccagttccaccactaggaatgtatagtac

SEQ ID NO: 393 - protein, 344 aa, Populus trichocarpa
MGEMPSFQLGVIGALFLSVASSVSIVICNKALMSNLGFPFATTLTSWHLMVTFCTLHAAQRLNLFESKSIEMKPVMLFGILNGVSIGLLNLSLGFNSIGFYQMTKLAIIPFTVLLETLFLKKQFSQKIKLSLFVLLVGVGIASVTDLQLNFVGTILSLLAIITTCVGQILTSTIQKRLNVSSTQLLYQSAPFQAAILFVSGPLVDQFLTRKNVFAYKYSSLVLAFIILSCIISVSVNFSTFMVIGKTSPVTYQVLGHLKTCLVLGFGYTLLHDPFTMRNIIGILVAIFGMGLYSYFCVQENKKKQSVDLSLASQMKDKDSAPILGMQDKEISHDAKKSTKDSLV

SEQ ID NO: 394 - DNA, 1195 bp, Populus trichocarpa
agatgggagaaatgccgagcttccaattgggtgttattggggccctgttcctttcagttgcatcatctgtctccattgtcatttgcaacaaagctttgatgagcaatctcggattcccatttgctacaactctcactagctggcacctcatggtaacattctgcacacttcatgcggcacagcgtctcaatttgtttgagtccaaatccattgagatgaagcctgtgatgctctttggaattctaaatggggtttctattggacttctcaacttgagtcttgggttcaattctattggattctaccagatgaccaaacttgcaatcataccattcactgtcctattggaaactctgttcctgaagaagcaattcagccagaagataaagctttcgctctttgtcttgcttgttggagttggcattgcctctgtgactgatctccagctcaacttcgttggaacaattctctctctcctagccattataacaacctgcgttgggcaaattctgacaagtacaatacaaaagaggctaaatgtgtcttccacacagctgctttaccagtcagccccatttcaagcagcaattctctttgtgtcaggccccttggtggatcaattcctcaccagaaagaacgtctttgcatacaaatattcttcactagtcttggcattcattatactttcatgcattatatctgtgtctgtgaacttcagcacattcatggttatcggcaagacctcaccagttacttatcaagtgcttggacacctcaaaacttgccttgttcttggctttgggtacactctgttacatgatcctttcacaatgagaaacatcattggaatactagttgccatttttggcatgggcctatattcatatttctgcgtccaagagaataaaaagaaacaatcagtggacctttcactagcttcccagatgaaagataaggatagcgctccaattttgggcatgcaagataaagaaatcagtcatgacgccaagaaatcaacaaaggactctcttgtttaatttgtcataaagaagttcatgcatgtatcgggtgtttgctctaccagaaacaattaatttgttgagttgagtataaatgttttttattcttttaatagacagtacccattcacttttttaccattgtattaattttagctctaaataaatcataacac

SEQ ID NO: 395 - protein, 340 aa, Sorghum bicolor
MTAGFQLGVIGSLTLSVASSVAIVICNKALISTLGFPFATTLTSWHLMVTFCTLHVAQRLRFFEPKAIDGQTVVLFGLLNGTSIGLLNLSLGFNSIGFYQMTKLAIIPFTVLLETIFLKKRFSETIKFSLLVLLLGVGIASVTDLKLNYLGSVLSGLAIATTCVGQILTNTIQRKLKVSSTQLLYQSAPYQAAILFATGPFVDHLLTGRSVFAHIYTFPVVGFIILSCLIAVSVNFSTFLVIGTTSPVTYQVLGHLKTCLVLSFGYTLLHDPFTARNILGILVAIFGMALYSVFSVREGKKKSAGDALPVSQMPDKETEPLVATKDNSDTKKANGVAHDC

SEQ ID NO: 396 - DNA, 1504 bp, Sorghum bicolor
gcacgagggcgctgcggaacggaaccaccagcgccattagaggccacaccacaccaacgctcctaccttctctcgcgcgcatatacgcatgtatgaggagatactagcaggaggactgctgcaaaggagagggacctgttgatttgaaagatcaatttgaagtagcagattcagaagtgcgtagccgaagcccgaagggcagcatacacagcagctggccaagatgactgccggtttccagctcggtgtgattgggtctcttacgctctccgtcgcgtcatcggttgccattgtcatctgcaacaaagccctcatcagcactctaggctttccatttgctacaactttgacaagctggcacctgatggtgaccttctgcacccttcacgtcgcgcagcgtctgcgcttcttcgagcccaaggccattgatgggcagacggtagttttgtttgggttgctaaatggaacctcgattggccttctgaaccttagcttaggattcaattccattggattctaccagatgacaaagttggccataatacccttcacagtgctattggagactatattcctcaagaaaagattcagtgagacaatcaagttttctcttctggtcttgctacttggagttggcatcgcttcagttaccgacctcaagttaaattacctcggatctgttctttctggcctcgccatagccacgacttgtgttggccaaattctcacaaatacgatacagaggaagctgaaggtctcatcaacgcagcttctgtaccaatcagcgccttaccaggcagccattctgttcgccactggccccttcgtggaccatctcctcaccggccgcagcgtcttcgcccacatatacactttcccagttgtgggcttcatcatcctgtcgtgcctgatcgcggtgtcggtgaacttcagcacgttcctggtgatcgggacgacgtcgccggtgacgtaccaggtgctgggccacctcaagacgtgcctggtcctgtcgttcggctacacgctgctgcacgaccccttcaccgcgcggaacatcctgggcatcctcgtcgccatcttcggcatggcgctctactccgtcttctcggtgcgtgagggcaagaagaagtccgcgggcgacgccctcccggtgtcacagatgcctgacaaggaaacggagccgctggtggcgaccaaggacaacagcgacaccaaaaaagccaacggggtagctcacgactgctaagatgtccccgttgcttatatagcttgattagcgcagctctagtgttactacgcactgtctgttctgaatctcagaaggtcagggaagaagccatattccttttgtttcttataatactgtatgtgtagtagcaccattttttttaatggcagtgggggtgttttagcacggtgtacaatttgatgcagcagctcttaaactgttactctgtttccgcgcgactcagcggattgggagtgtacccaccaagctagcaaa

SEQ ID NO: 397 - protein, 290 aa, Oryza sativa
MERPAPVRKSHTSTADLLAWPQQQHQPDGHAASTPSPARRPHQPSEALRKVVFGGQVTEEEAESLNKRKPCSAPKWKEMTGSGIFAAGADGEAEEPGSAAAPGRAAPRNYQPVTVSHISFAEDGSVPPKKPTSVAEVAKQRELSGTLQSEADSKMKKQISNAKSKELSGHGLFDPQDVRPNGARNTANGTGASHTPVRNANVSSFSFGEANTDSVTKTAKKITGKKFTDLTGNNIFKGDEAPASAEKHLSTAKLKEMTGSNIFAEGQAPTREYHSGNRKPPGGESSIALV

SEQ ID NO: 398 - DNA, 1384 bp, Oryza sativa
actactactacttcacctcacgagtctcacgcacgcaccacctccctttctagagagagaaatagcaccaacaaacaacaacgcctatagtctagtagagcctagagagagaaagcgcgaggagaggagaggagatggagcggccggcgccggtgaggaagtcccacacctcgacggccgacctcctcgcctggccgcagcagcagcaccagcccgacggccacgccgcctccaccccctcccccgctcgccgcccccaccagccatcggaggcgctgaggaaggtggtgttcggtggccaggtcacggaggaggaggccgagagcctcaacaagaggaagccatgctccgcgcccaagtggaaggagatgaccgggagcggcatcttcgcggccggcgccgacggggaggcggaggagcccggcagcgccgccgcgcccggccgcgccgccccgcgcaattaccagccagttactgtgagccacatttcatttgctgaggatggaagtgttcctcccaaaaagccaacttcagtggctgaggtagcaaagcagcgtgagcttagcggtactctgcaaagtgaagcagacagtaagatgaagaagcagatttcaaatgcaaaatcaaaggaactcagtggccatggcctttttgaccctcaagatgtaaggcctaatggggcaaggaacacagcaaatggcaccggtgcctcacacacacctgtgagaaatgcaaatgtgagcagcttctcgtttggggaggccaacactgacagcgtgacgaaaactgcaaagaagataactggcaagaaattcaccgatctcacaggcaacaacatattcaaaggagacgaggcccctgcttctgcggagaagcatctgagcaccgcgaagctgaaagaaatgactgggagcaacatattcgcggaaggacaggcgccaacccgagagtatcatagcgggaaccgcaagcctcctggcggcgagagcagcattgcgctggtttagcattctggtggacaccgtcgctgtccgtgttttcctctttaggatgaaccctaggagtcgttctatcagcagattgagctgccagtttgctttcctgtttcgacggttaggcataaagtttgtttcctgctgatgtgggtaaagacaggctatgctctcctagcataacatttgttgtggtgttgtagtttggtatggtcagtcactttgctgtgacatactcaaatggaacagcctacatggtgtgcgctctcatttctgtgactgaagatgccgttgctttggtgtctctcctttcattgtgtacgccagatctgtactgttgacaaataataaattggttggtatgttgcctaaaatgcagctgtgaatacaaa

SEQ ID NO: 399 - protein, 277 aa, Sorghum bicolor
MERAAPVRSSHTSTAGLLAWPHPDGAGSLPARRPNQPTEEFRKVVFGGQVTEEGAGGHNKTKMRATGSAPKSKETAGIGIFKAESAAAAVATASRDRQASQITFSQDGTIPPRKPTSVAGVARQRELSHTVESEGDSKMKRQVSSAKSKELSGHDIFADHEVPKPNRSRRSDYGSSATLSPVKNANVSSFSFGEADTDSAVKTAKKKGSSNKSTDLNGKTISGRDSVPAEKQALNRAKPKGMSGSSIFADGKASTTGDHAGRRTRQPPGGDSSILLG

SEQ ID NO: 400 - DNA, 1287 bp, Sorghum bicolor
acttcctcaccttctcatgagtcgagcctccgtggacgacgcattcattcgccttgatctccaatccctccctcccttccttccttccggagagatcgagaggggcaggcagggagatggagagggcggcccccgtgaggagttcccacacctcgacggccggcctgctcgcgtggcctcaccccgatggcgccggctcgctgccagcacgccggcctaaccagccgacggaggagttcaggaaggtggtgtttggggggcaggtcaccgaggagggcgccggcggccacaacaagaccaagatgagggcgacgggctccgcgcccaagtcgaaggagacagcagggatcggcatattcaaggccgagagtgccgccgccgccgtcgcaactgcctcccgcgatcgtcaggctagccagatcaccttttctcaggacgggaccattcctcccaggaagccaacttcagttgctggggtggcgaggcagcgtgagcttagccataccgttgagagcgagggggacagtaagatgaagcggcaggtgtccagtgcgaaatccaaggagctcagtggtcacgacatctttgctgatcatgaagttcccaaacccaacaggtcaaggagatcagactatggcagctccgccacgctgtcacctgtgaaaaatgcaaatgtgagctccttctcgtttggagaggccgacacagacagcgcagtgaaaacagcaaagaagaaagggtccagcaacaagtctactgatctgaatggcaagaccatctccgggagagattcagtgcctgcagagaaacaggctctgaaccgcgcgaagccgaaaggaatgagcggtagcagcatttttgcagacgggaaggcctcaacaaccggagatcatgcaggccgtcgaacccggcagcctcctggcggcgacagcagcatcttgctgggctagcgtgcatatggatcttattgtcctatgccgccgcacgggtggttggtccgtcagtctgcgtccttgttttcgtgatcaggcgatgagtcccatctccagtctttgagatgatctggttcacttctggcgtggtttggtctgtgttggttgtggcatgcccgatggaacaacccctgatggaacaaccctatccctatggcgtttggtgccgttttgttgtgtacaatggatggcgtgtgctgccgttttcttgtgtgtacaatggatatatgtatacacacatatatgtgtgttttgcttattaaatacgaaaaattggtatgtggtaccagtagtc

SEQ ID NO: 401 - protein, 278 aa, Arabidopsis thaliana
MSRRLFACFGLKKSSTKPISGGNNSAAVAAEIPAGDGPVLVQLFSSQGCKTSPAAEMLMSRLGRGDFDAQIRGEDGGSGSPTMVLVFHVDYWDYKGWKDPYGSSQWTVRQKAYIEALNLDTMFTPQLVIQGRSQLIGNEEETLLKSISEAPRFPSPAFRATFQRPTSETLQVSLTGALRMKVDGDGMDIMVAIYETGLVNDCARGENEGRMLSNDYVVRKMEKMCTVKDVAPKKPVSGTAHFTLWDGFNSSKCGVAVFLQNSSLQIFGTQSFKLPDEI

SEQ ID NO: 402 - DNA, 1168 bp, Arabidopsis thaliana
ggtgccgctcgacgtgttaatcttcttcctcctgaagatctctctctgaaagacattctcaaattttctcgggaaaacacctttttctgattcgtttttctccagatcattccttctttcttatatccgatttcttcgggaggaggcgaagagacggtcaacaattttatccaatgtcgcgccgtcttttcgcctgtttcggcctcaagaaatcttcaactaaacctatctctggtggtaacaattccgccgccgtagccgcagaaattcccgccggagatggtcccgttctcgtccagctattctcgtctcagggatgtaaaacatcgcccgcggcggagatgttgatgtcccggctaggtcgaggtgatttcgacgctcagatccgtggcgaagatggtggatctggatctccgacgatggttttggtgtttcatgtggattattgggattacaaggggtggaaagatccgtatggatcgagccaatggacggtgaggcagaaggcgtatatagaggcgttgaatctggatacgatgtttactccgcagcttgtgatccaaggtcgttctcaattgatcggaaacgaagaggagacgctgctcaaatctatctccgaagcgcctaggtttccttctccagccttccgggcgactttccagagaccaacctcagagacactgcaagtatcactcaccggagctttgagaatgaaagtagacggagacggaatggacataatggtggcaatatacgaaaccgggcttgtgaacgactgtgcaagaggagagaacgaaggaagaatgttgtcgaatgattacgttgtaagaaagatggaaaagatgtgcactgtgaaagatgtagcaccgaagaagccagtctcggggactgctcattttacgctctgggatggattcaacagcagcaaatgtggagtcgccgtctttcttcagaactcttctcttcagatttttggtacacagagttttaaattacctgatgagatttgagttaatttccctaatatctgaaaaataaagaaaagaaaaccgatctttgtatcgtccatattttgcttgtgataatcattcgggttccactctgcttttgtacagttataaatgtgtgactacttataacttaatagggtttaaggtttcttctaatt

SEQ ID NO: 403 - protein, 282 aa, Arabidopsis thaliana
MAPRLFTCFGVKGSSTSTTTGKGISGHNAANVAADVPVGDGPILVQLFSSQGCKTSPEAEMLVSRLGRGDFDGKIRRDGGSSGSPAMVLVFHVDYWDYLGWKDPYGSSQWTVRQKAYIEALNQDTMFTPQFVVQGRVQLLGNEEESLLKSIVEAPRFPSPAFRATFQRPTSETLQVSLTGALRMKVDSSGIDIMVALYENGLVNDCARGENSGRVLSNDYVVRKLEKLCTVKDLTGKKTVSGTAHFTVWDGFNSSKCGVAVFLQNTSLQIFGTQSFQLPDEI

SEQ ID NO: 404 - DNA, 1210 bp, Arabidopsis thaliana
atggcgcctcgtcttttcacatgttttggcgtcaaaggatcttcaacttccaccaccaccggaaaaggtatttccggtcataacgcggctaatgtagctgctgatgttccggtaggtgatggacctattcttgttcagcttttctcatctcaaggatgtaaaacttcgcctgaggcggagatgcttgtatcacgtcttggacgtggtgatttcgatggaaagatccgtcgagacggtggatctagtggttctccggcgatggttttggtttttcacgttgattattgggattatcttggatggaaagatccttatggatcgagtcagtggaccgtgagacaaaaggcctatatcgaggctttgaatcaagatacaatgtttactccacagtttgttgttcaaggtcgtgttcaattacttgggaatgaagaagagtccttgcttaagtctattgttgaagctcctaggtttccgtctcctgcgtttcgggccacatttcaaagaccaacatcagaaacccttcaagtatctctcaccggagctttgaggatgaaagtggactcgagcgggatcgatataatggtggcgctatatgaaaacggtttggtgaatgattgcgctcgaggagagaactcaggaagagtcttgtccaatgactacgttgtaagaaagctagaaaagttatgcaccgttaaagatttaacgggaaaaaagacggtgtcagggacagctcatttcacggtttgggatggattcaacagctctaaatgtggagtcgctgtttttctacagaacacatctcttcaaatttttggtacgcagagttttcaattgcctgatgagatttgacaaaggaacaaaatttctgaatctatttttttttttttttatagaaatgaattttgcacttttgtgttcgttcatatttggttattattggaacttttgtgtgtatagaaggatatttgtcactctcattataggcatttgctttgtttaaaccctttcaattttctttctttctaagttatgccatcccactccacttttaggacagcattatataatgattttaatatataaaccaaacttagtattttgtgggtttaaatccgatgcaggttgacaaatgttttgttgacttgtgttaattcgtgaagttttgtaaggacgataataattgaaacattaatatggaagttattgaaac

SEQ ID NO: 405 - protein, 273 aa, Oryza sativa
MAPRLLSCFGRGSATASAPDQPEEAAAAAAPGPVLLELFCSQGCGASPEADAVAARMVHEDQQRAAAGEGGGGERGVVVLGFHVDYWDYRGWKDPFASSAWTVRQKAYVEALRLDTLFTPQAVVQGRAHCVGTEQDALAQAVRDAPRYPAPAMKVTFQRPNPSTLQASFTGTLRSRMEGGGSVLVALYESGLVTDCGRGENKGKSLLNDHVVRRLEKVAAVRDGASAKKSVSGSVQFPLWDGFRASRCGLVLFVQNAALQVLGVQHFDLPDNV

SEQ ID NO: 406 - DNA, 1196 bp, Oryza sativa
ctcacctttcacccacccaccaccacaccacagctacttaccttgcccgccacacactacaccagcttagctagctagctcgctcgctacctcctccttggttcattcccttcacggctaagttcccagatagccagcagcgatcgtagtgtgtcgcaacatggcgccgcggctgttgtcgtgttttggcaggggcagcgcgacggcgtcggcgccggatcagccggaggaggcggcggcggcggccgcgccggggccggtgctgctggagctgttctgctcgcaggggtgcggggcgtcgccggaggcggacgcggtggcggcgcggatggtgcacgaggaccagcagcgggcggcggcgggcgagggaggcggcggggagcgcggcgtggtggtgctgggcttccacgtcgactactgggactaccgcgggtggaaggacccgttcgcgtccagcgcgtggacggtgcggcagaaggcgtacgtggaggcgctccggctcgacacgctgttcacgccgcaggccgtcgtgcagggccgcgcccactgcgtcggcaccgagcaggacgccctcgcccaggccgtccgcgacgcgccccgctaccccgcccccgccatgaaggtgacgttccagcggccgaacccgagcacgctgcaggcgtcgttcacggggacgctgcggagccggatggagggcggcgggagcgtgttggtggcgctgtacgagagcgggctggtgacggactgcgggcgcggcgagaacaaggggaagtcgctgctcaacgaccacgtggtgcggcggctggagaaggtggccgccgtgcgcgacggcgcgtcggcgaagaagtccgtgtccgggtccgtgcagttcccgctctgggacggcttccgcgcctcccgctgcggcctcgtcctcttcgtccagaacgccgcgctgcaggtgctcggcgtccagcacttcgacctgcccgacaacgtgtgactactcgcggtcggtcggtcgaggcttgcgcctgcgtgtgtagacgtgtgccgtgtaatgtactactagtaaatattctttgtagagtacacgtttgattattgatcgacgcgtttgtattgttgttgatttgttgggggtacgagactagacgagagtggggagatgggtaattggagacattattaattcagacattgcagcagccttgcag

SEQ ID NO: 407 - protein, 271 aa, Populus trichocarpa
MAPRLLSCFGKRNSDSSSKNQNHANVTVDVSAEEQRRGGAVLVELFSSQGCATSPAAELLVSRLGRGDFQLEMPVIILAFHVDYWDYMGWKDPYGGSQWTVRQKAYVESLKLDTMFTPQIVVQGRTQCVGNDEEALLSSIVNAPRFPSPTFQATFLRPTTDSLQVSMSGALRAKVDHNGVNVMVALYESGLVTDCPRGENKGRVLSNDYVVRKLEKLCTVKDISAKKTVSGTVNFALWEGFNSSKCGIAVFVEDSSHQIFGSQSIQFPDTL

SEQ ID NO: 408 - DNA, 1061 bp, Populus trichocarpa
aatgtagaaataaaaatgaaagcatcctcgaacgtgaagaccaacaaaaatattccaagagtagagccagcttttctttcgcctaccttctctcttaaccacaaaattttctcaccctccctgtgatttctttcattacacctaatatcttccctttctttactctgcctctcttgcatttctttctttctcttttgtcaaggcaaaccggaggacaagggactgccgtgccgcatcataacaatatggcaccacgtctcttatcctgcttcggcaaaagaaatagcgattcctcttcaaaaaaccaaaaccatgcaaatgtaacagttgatgtatcagcggaggagcagcgccgtggaggggctgtgttggtggagctgttttcttcacagggatgtgcaacatccccggcagctgaattgttggtgtcaaggctagggagaggggactttcaacttgaaatgcctgttattattttggcttttcatgtcgattactgggattatatggggtggaaagacccttatgggggtagtcagtggactgttagacagaaggcttacgttgagtctttgaagcttgatacaatgtttacgccacaaattgttgttcaagggagaactcagtgtgtgggaaatgatgaggaggctttgctgtcttccattgtcaatgcaccaaggtttccttctcccacatttcaggcaacatttctaaggcctacaacagattccttgcaagtctctatgtcaggagctttaagggctaaagttgaccataatggtgtcaatgtcatggtggctctgtatgagagtggattggtgacagactgtcccaggggagagaacaaagggcgtgtcctgtcaaatgactatgttgttagaaagcttgaaaagctctgcactgtcaaagacatctctgccaagaagacagtttcaggaactgttaattttgctttatgggaaggcttcaatagcagcaaatgtggtattgctgtctttgttgaagacagctcccatcaaatttttgggtcacagagcattcagttcccggatacattatga

SEQ ID NO: 409 - protein, 264 aa, Populus trichocarpa
  VARIANT 86, 199: Xaa = Any Amino Acid
MAPRLLSCFAKGNDSSARNQNHANVTVDVSAEEQHRGGAVLVELFSSQGCKTSPEAELLVSRLGRGDFQLEMPVIVLAFHVDYWDXMGWKDPYGGSQWTVRQKAYVESLKLDTMFTPQIVVQGRTQCVGNEEEALLSSIVNAPRFPAPTFQATFQRPTPDCLQVSLSGALRTKADNDGVNVMVALYDSGLVTDCPRTDXVLSNDYVVRKLEKLCTVKDISAKKTVSGTVNFALWEGFNGSKCGLAVFVEDSSHQIFGSQSIQFP

SEQ ID NO: 410 - DNA, 790 bp, Populus trichocarpa
atggcaccacgtctcttatcttgctttgccaaaggaaacgattcttccgcaagaaaccaaaaccatgcaaatgtaaccgttgatgtatctgcggaggagcaacaccgtggtggggctgttttggtggagttgttctcttcacagggatgtaaaacatccccggaagctgagttgttggtttcaaggctagggaggggtgactttcagcttgaaatgcctgttattgttttggcttttcatgttgattactgggattaaatgggttggaaagatccttatgggggtagtcagtggacagttagacaaaaggcttatgttgagtctttgaagcttgatactatgtttacaccacagattgttgttcaagggagaactcaatgcgtgggaaatgaagaggaggctttgttgtcttccattgtcaatgcaccaaggtttcctgctcccacttttcaggcaacatttcagaggccgactccagattgcttacaagtctctttatcaggagccttgagaactaaagctgacaatgatggtgtcaacgtcatggtagctctctatgacagtggattagtgactgattgtcctaggactgattgtcctatcaaatgactatgttgttagaaagcttgaaaaactctgcactgtcaaagacatctctgccaagaagacagtttcaggaactgttaattttgctttatgggaaggcttcaatggcagcaaatgtggtcttgctgtctttgttgaagacagctcccatcaaatttttgggtcgcagagcattcagttcccg

SEQ ID NO: 411 - DNA, 797 bp, Sorghum bicolor
aactggatgtgaatgtgatcgaggttagctagcaactatggccatggaccagccagcaatgcccatgctcatgtccaccgactcagccgccgccgtcatggtgctcctttccgtggccacgcttcttcttgccctcaaccaccacttgctctcgtcatggcgacgacgtgcaagcagcgcaacaaggacctgctggacatcctgctggacaaggcggaggacgagacggcggaggtgaagctcaccagggaaaacatgaaagccttcatcattgacgtggtgaccgccggctcagactcgtcggcggtgacggtggagtggatgctggcggagctgatgaaccacccggaggcgctcggcaaggtgcgggacgagatcgacgcggtggtcggcggcggggacggcaggatcgtgggcgaggcggacctggcgaggctgccgtacctgcaggcgacgttcaaggagacgctgcggctgcacccgggggcgcccatcgcgcaccggcagtcgacgacggagatggtggtgcgcgggttcacggtgccgccggagacggcggtgtacatcaacctgtgggccatcggccgcgacccgtccttctgggaggacccgctggcgttcaggccggagcgcttcatgcccggcggcgccgcggaggggctcgagccccgcggcggcggcggcggcggccagcagttccagttcatgcccttcggcagcggccgccggggatgccccggcatggggctcgcgcagcagtccgtgccggcggtgctcgcggccctcgtgcagtgctt

SEQ ID NO: 412 - DNA, 737 bp, Sorghum bicolor
gagtcggacttccccgtggcgccgctggcgccgttcaactacacggggacgccgcccaacaacaccaacgtggccaacgggaccaagctgatggtcatcccgtacggcaccaacgtggagctggtgatgcagggcaccagcatcctcggcatcgagagccacccgctgcacctgcacggattcaacttcttcgtcgtcggccaaggctacggcaactacgacccggtgaacgacccgcccaagttcaacctcgtcgaccccgtcgagcgcaacaccgtcggcgtgccggccggcggctgggtggccatacgcttccttgccgacaaccccggggtatggttcatgcattgccatttggaggtgcacacaacatggggcctcaggatggcatggttggtgcttgacggcagcctcccgcaccagaagctgctcccgccgccgtccgatcttcccaaatgctgattagactccctccctcagctctctatctctctcctgcgccggtcgcttcaaagggaattgtgaattagacttgatcacaaatgttgattttttgtttgtttactttcttcattgccaattgcaattctttcagcttccatttaaactagtccgttcctagctgacctggactttttgtaatcttttcttctatttgtttgccaccctctgtaatgacaaaatgtttttgggagaataaagaatggcgtgacttgcaccagatccatagaattctc

SEQ ID NO: 413 - DNA, 1205 bp, Sorghum bicolor
cctactggacgcacacattaaacacattattcctccatctcctcgatcgcctggccggccgtcttggttgccctctagagctcgagagcaactcaagatatagctagctagctgctcatcggagtctagctagaggtttaaccatcagctagctagctggccatggcaatctcctctgctcttccctgctccctcctcatggcggccctgatgctcctcgcctctgccgtcgaagtgcaaggcatcacgaggcactacgacttcaatgtgacaatggcgaacgtgacacggctgtgcgccagcaagagcatcatcacggtgaacgggcagttccccggccccaagatcgtcgcgagggaaggcgaccgcctcgtcatccgcgtgaccaaccacgcccagcacaacatctcgctgcactggcacggcatccggcagctgcgcacggggtgggcggacgggccggcgtacatcacgcagtgcccgatccagacggggcagagctacgtgtacaactacaccatcgtcgggcagcgcggcacgctgtggtggcacgcgcacatctcctggctgcgcgccaccgtctacgggcccctcgtcgtcctgcccaagctcggcgtcccctacccgttcccggcgccgtacaaggaggtccccgtcatcttcggtgagtggtggctggcggacacggaggtggtgatccagcaggcgcttcagctcggcgctggtccgaatgtctctgacgcccacaccatcaacggcctaccaggaccgctctacaactgctctgccaaagacacgttcaagctgaaggtgaagccagggaagacgtacatgctccgcctcatcaacgcggcgctcaacgacgagctctttttctccatcgccaaccactcgctcaccgtcgttgaggtcgacgccgtctacgtcaagcccttcaccgtcgacaccctggtgatcgccccgggccagaccaccaacgtgctcctcgccgcgaagccgttctacccggccgccaactactacatgaccgccaggacctactccaccggccggccggccaccttcgacaacaccaccgtcgccggcatcctcgagtacgagtaccccgacgcgccctccgccgcggcgagcttcaacaaggccctgccgctctacaggccggcgctgccgcagctcaacgacaccagcttcgtcggcaacttcac

SEQ ID NO: 414 - DNA, 1089 bp, Sorghum bicolor
gcacgaggcaacttcccaactcccagtccctccctaaactcgcaagcaacccgcggctgagctccgtgcaccagttgtctcgcgttgctgccggtgctgcaggcggcattgtcggcgagcttaggatgggtggcatggtggcgtcggtggcggcggcgctggtcgtcgtccttggcgtggcgtcggtggcgacggcgcagttggagacctgcaacggcgacctcccgcccgtgctcgccgccaactactccggacttgcctgccagccggtctggaacaacttcgtgctccggtatcaccaggacaagaacaacgtgctccggatcgtgctgtcgacgatgtacagcacggggtgggtgggcatggggttctccagggacggcctgatgatcggctccagcgccatggttgggtggatcggcaagaaggggctcccccacatccggcagttcgcgctgcgcggcaagagcagctccaaggtggtcgtggaccgcggcttcctcgtctccaacgaccacgaccacaccgtcgtggtgcagcaggccaagatctacctcgccttccagctcaggttctcctaccgcctctcccaccagcacatcatcatggccttcggcaacagcatccccgtcaagaacaagctcaccaggcaccaggacaagacttccttcaccttcgatttcaccactggcagagcttcggtggacgaggtggtttaagaacagcacctccaccccgacctactagaaacctgctgcgtgtttgtgttgtcgtggcggcggcgacgcgatcgagaacgcgaagggcagcccctaattttttttaaaaaaaaaaaattatggttctttttccagggttggatgatgttgtgttgccctgaccttgtttttttttctttgttggtgtatgaattgttcggaactgcaatcgtgtcagtgtgtgagtttaggcaagtgcactggcactgcccataggtgtgcacgcctggtggtatagtggtcctctatgattctttgtttctcgaggcatgttacagcccgtgtatgataatttgaacgagaacaagcgtgcccatatatagcttcaccc

SEQ ID NO: 415 - DNA, 1250 bp, Sorghum bicolor
gcacgaggcggagtaggtgcagcagagcagacgcagagcggcacagcaatggcggaggctcgtaactacgacagtattgtcaacaggaatgagatcacggacgctgcggcttcggcgttcgccaaccccgagcagatcccggagaagtacgtccgaaccgaggaggtcctcgacggcgtcgtcgtcggtgaggacgagcgctacgagctgccggtcgtcgacatggccaggctcctcgacccggagctgtcggcgtcggagatcgccaagcttggcgatgcctgcagaaactggggtttctttcagctgacaaaccatggagttgacgaagaagtggtacagcgaatgaaagacagtaccgtgcagttcttcagcttgccgctggaaagcaaggccaaagtggccgtccgaggaaacggcttcgaaggattcgggcaccactacagcagagcgtccagtggtaagctggactgggcggagagcatgatcctcgtcacgcagccagtccacgacaggaacatggaaatgtggcctacaaatccacccacgttcagggacgcgcttgaggtttactctgtggagatgatcgacctggcaatgaagctcctgggtttcatggcggccgacctcggggtggagcaggaggcgctcctggacgccttcacggggaagcggcagagcatggcgatccactcctacccgccgtgccgccaccgggagaaggtgatgggcatcacgccgcacacggacgggctgggactgacgctgctgctgcacgtcgacgacacgccgggcctgcagatccgcaaggacggcaggtggttccccgtgcgcccgctgccgggcgccttcgtcgtcaacgtcgccgacatcctggacgtgctcaccaacggcgcctacgccagcgtcgagcacagggtgctcccggacgccgagaggggccggaccaccgtcgtgatattccaggaggcgtccgtcggcggcctggtggcgccgctgccggggctcctcctcgaggagggcggcgcccacgcgcggtacagatccatcgagattgaggagtacatcaagggaaacttcaacgcgctggagcacgggacacggttcatcgagagcctcaggatatagtagagtcgtcatcgtctgtggattctcgcacgcgtcaaaacagatgtactagttgctccttcagttcgaaaataattgctcaactcatatttcaacgagccaaccaatcttaaaacatatct

SEQ ID NO: 416 - DNA, 650 bp, Sorghum bicolor
cctactgggatgcacaggcggcagtgacgacgcgcgcaaaccgacgacggacggactagggtagctgctcctcagctatccagatcgttcgttgccttcagccttgcttccttccgtgtcgggcggaggcggacgcggacgcgcgcagcagcagcgggaatgggacgccacgcggcctccggcggcggcggcggcgtgcagcagaagctgcgcaagggactctggtcgcccgaggaagacgagaagctctacaaccacatcatccgctacggcgtcgggtgctggagctccgtgcccaagctcgcagggctgcagaggtgcggcaagagctgccgacttcggtggatcaactacctgcgccccgacctgaagcggggcagcttctcgcagcaggaggaggacgccatcgtcggcctccacgagatcctggggaacaggtggtcgcagatcgcgtcgcacttgccgggccggacggacaacgagatcaagaacttctggaacagctgcctcaagaagaagctgcgccagcgcggcatcgaccccagcacccacaagcccatctccgccaacgcggcctcggcattggaacagccggcggcgtcgcaagagcgcaagccgttgtccacagccgccgctgatggcggcttcga

SEQ ID NO: 417 - DNA, 677 bp, Sorghum bicolor
gggctcggccacgacagcccgatgtgggcggcgctcaaccacggcgggcggacggtgttcctggaggaggacgcgtcgtggatcgccagcgtccgcgccacgcacccgtccctcgagtcctaccacgtggcctacgacacggtgctcaccgacgccgacgcgctcctccagctccgcgaccacccggcctgcgtcgcgcagccggacctcgcgtccgccgccgacgcctcctgccgcctcgcgctgagggggctgccgccggtgttccacgagctggagtgggacctcatcatggtggacgcgcccacggggtggacgccggaggcgcccggacggatgggcgccatctacaccgccggcatggcggcgcgcgcgcgcaggcccggggatggacccaccgacgtgttcgtgcacgacgtcgaccgccccgtcgaggacgccttctccaaggccttcctgtgtgaggggtacctcgccgagcaggtcggccggatcaggcacttcgtcatcccgtcacaccgcgagaaggacggcacgccattctgcccttgatagagaactttgtttcttgcattcagagccatccatctatccatctatccatcctttttgctttgctttggtcagttgctgtgctttgccttgcctttacatacacatatatatatatacaagag

SEQ ID NO: 418 - DNA, 493 bp, Sorghum bicolor
  misc_feature 420: n = A,T,C or G
gcacgagggacagcgccaccaggaagcgcaatatccatggagtcctgaacgccgtgagctggggcgtgctgctgcccatgggcgccatcttcgccaggtacctcaagacgttccaggcggcagacccggcgtggttctacctccacgtcacgtgccagctgatgggctacgccgtcggcgtctccggctgggccaccggcatccaactcggcaaggagtccaagggcgtcacctacaccgatcaccgcaacatcggcatcgcagtctttgctctcggcacccttcaagttctggcgctgttcctgcggccgaagaaggagcacaagtaccgggtgtactggaacatgtaccaccactcggtggggtacaccgtcatcgtgctgggcatcgtcaacatcttcaagggcatgaacatcctgngcgtggagcagcggtggcggacagcctacatcgccgccgtctgcgtgctgctcatcgccgccgccgcgctgga

SEQ ID NO: 419 - DNA, 600 bp, Sorghum bicolor
gcacgaggatcgtcttcctcctctcgtcctcttccttctagctaccactagcagcaaagccaggcaaactaataagttgggagtgagtgtgtgttgaagaggatctcgattgatcatcgatcgagaagaagcgagcttattattagagagatcgacacacactagcagtctagcacctgcacggggaaagaattaaagaacaaagaagagcaaggatcaagctaagatcatcaatgagcatctcggtgaacgggcagtcgtgcgtgccgccggggttccggttccacccgacggaggaggagctgctcaactactacctccgcaagaaggtggcctcccaggagatcgacctcgacgtcatccgcgacgtcgacctcaacaagctcgagccatgggacatccaagagaaatgcaagatcgggtcgggcccccagaacgactggtacttcttcagccacaaggacaagaagtacccgacggggacgcgcacgaaccgcgccacggcggccggattctggaaggccaccggccgcgacaaggccatctacaacgccgtcaagcgcatcggcatgcgcaagacgctcgtcttctacaagggcc

SEQ ID NO: 420 - DNA, 1809 bp, Sorghum bicolor
gcacgagggttacagccagtgagcggcccagtcggtcggtcgagcgagggagctggacccctacccctgcccccgcgttatatctgctgcgctgcgctgcacagacagactccagctcggccggtcactagtgatagtggatagctcgcctcgcccgccagccgccccgctagaagctcgcatcgatcgcgccccagatcccaatgcgccccgccgcgtcgctctaggccgcggaagatagctgtgtgacacgccgtgcagccatcatcagccatgaaggtcctcgccgtgctggcgctcgtcgccgccgccgcgccgttcctccgcgccgccggccagggcgaggaaggggccgggccgctgccgttcgcggtgggcgcggcgccggcgggctgcgacgtcgcacagggcgagtgggtgcgcgacgacgacgcccgcccgttgtaccaggagtgggagtgcccctacatccagccgcagctgacgtgccaggcgcacggccgccccgacaaggcgtaccagagctggcgctggcagccgcgcggctgctccctgcccagcttcaacgcgacgctgatgctggagatgctgcgtgggaagcggatgctgttcgtgggcgactcgctgaaccgggggcagtacgtgtccctgctgtgcctcctgcaccgtgccatccccgacggcgccaagtcgttcgagacggtggactcgctgagcatcttcagggcgaaggactacgacgccaccatcgagttctactgggcgcccatgctggctgagtccaactccgacgacgccgtggtgcactccgccgacgaccgcctcatccgcggcgcgcccatggacaggcactccagcttctggaagggcgccgacgtcctcgtcttcaactcatacctctggtgggtcgccggggacaagatccagatcctgaggggcgccgacaatgacccgagcaaggacatcgtggagatgaaatcggaggaggcctacaggctggtgctgtaccaggtggtccggtggctggagcgcaacgtggacgccaagaagtcgcgggtgttcttcgtcaccgtgtcgccaacgcacacagagggcaaggcgtggggcgacaagaaggagggcgccaattgctacggccagacgtcgccgatcagcgacggcgcctcctcgtacagggacagcacgagccgggagacgcagcgggtgacggaggaggtgctggccacgtcgcgggtgcccgtcgggctcgtcaacatcacgcggctgtccgagtaccgccgggacgcgcacacgcagacctacaagaagcagtgggcggagccgacggcggagcagcgcgccgaccccaggagctacgccgactgcacgcactggtgtcttcccggcgtgccggatacgtggaacgagctgctgtactggaagctcttcttccctagcaacgatcagttcctctgatgatgcgtgcctgcgtgcctctgcctgcatacatacagacacttggacacggccggactgctaggggctagcccaaagtaacatcctttgtgccggcatgcacagcgtcgatcgaaacagaacaaagaaatgtagatgaagaactgaacctcgtgtaagtgtaagtggtgtacatggatgcgtgcgccatgctcaacgttagttcgtggttcatggagcagaaactttccgttgatgtaatcagtttttctttcttttttgggggtcgctgtaagatcgaggctcttttttgtgtcaatttcaaagaatccaggggaaaaaaatcttcttctgcgtaaaacaagattcagcaaa

SEQ ID NO: 421 - DNA, 622 bp, Sorghum bicolor
  misc_feature 17: n = A,T,C or G
cgcactaccagcgccgntacgccggcgtgctcctcgccgacttccccaccaccccgccgcaccccttcaactacacggggaccccgcccaacaacacgttcgtgcagcacggcacccgggtggtgccgctcaggttcaacacctccgtggagctggtgctgcagggcaccagcatccagggcgccgagagccacccgctgcacttgcacggctacgacttcttcgtcgtcggacaggggttcggcaacttcgacccggtgaacgacccgcccaactacaacctcgccgaccccgtggagcggaacaccatcagcgtgcccaccgccggctgggtcgccgtccgcttcctcgccgacaacccgggggtgtggctgatgcattgccacttcgacgtgcacctgagctggggcctgtccatggcgtggcttgtcaacgacggcccgctgccgaatcagaagatgttgcccccgccatccgatcttccaaaatgctgatgactgatcgttcatcatccgagggggggtagatgggcatttaacaaggttttggtgcacgtctgcgtactttcttacgatgtttgaaacaatttggtctgggatatttaattgcagtgtgccgattt

SEQ ID NO: 422 - DNA, 650 bp, Sorghum bicolor; identical to SEQ ID NO: 416

SEQ ID NO: 423 - DNA, 1455 bp, Sorghum bicolor
gaggggagccaagctaagaaccacaatttttctgaaggaacaatgaaatcagaagcctctcacaagatgacagtgctccatgctccagttggagtgaggagcatcgtgacctccttggtggctttcttcatcctagccagctccatcgtcttcctccttgacagaggccaggaagcgcaagtgcaaatggctgtcgagagaactgaagaggaggacgcgagcaacgaggagtgcaactggtcgagggggcggtgggtgtacaacaacgtctcccggccattgtacaacggcctcaagtgcgccttcatcttccccgaggtggccttttcaaaacagatttgatgccatcaagctgcttgaaaagctgaggaacaagagattggtgtttgtgggtgactcagtcaacaggaaccaatgggtctctcttgtgtgcatggtggaggcctcaatacctgacgacaggctcaagatacgcatcttcaatggctcactgatctccttcaaggggttggtatgcttcccttcacaattctacaggctacaaaaaccaacaattttatttggttagctggtctgaacatataatcattttcaggaatacaatgcaacaatagatttctactggtcaccactactggtggagtctaacagcgacaatcccattatccaccgggtggagtaccgaatcataagggcagacagaattgagaagcatgccagtgtccggagggatgctgacatcatagtcttcaattcttacctgtggtggaggaagcagaaggatgacatgaggatgaaggtcatgtaagtacatttctatccttcctaatcatagttcataggcattttgcaccgtcactttcgtatatcagaaacaagataccagaaccggtaatttaaaatgcactaaatagtttgccattagtaacttaaaatacactaaataattagcaaatgccattagtacaaaggagatcatatttagcattttaaatgccatttgtatgtgcaggtatggttcatttgaagatggtgatgcaaagttagacgaaatggaaatggtcgatggttttgagatagctatcaagaaactaacggaatggcttggagagaatattgacaagaacaagactaggatcttttttgcaggatcatcaccaacacattcctggtgagagagatacctatgaatcatttgcacaaatagtacaataccaacatctccatgacatccagtgttcacatatatatgttacttcagggccagcaactggggtggagaagacaagaacaaatgccttaatgaaacggagccaatctacaaaaaaggttacaaagctgcaactacggactacagcttgatggccacggccaagtcctattttcgaacattggagccaaaaggcatacatgttcagatactgaacatcactgaactgtctgactaccgcaagg

SEQ ID NO: 424 - DNA, 778 bp, Sorghum bicolor
ctgggactaccgcgggtggaaggaccccttcgcgtccagcgcctggaccgtgcgccagaaggcctacgtggaggcgctccgcctcgacacgctcttcacgccgcaggtcgtcctccagggccgcgcgcactgcgtcggcaccgagcacgacgcgctcgcgcaggccgtccgcgacgcgccgcgataccccgcgcccgccatcaaggtcacgttccagcggccgaacccgacgacgctgcaggcgtcgttcacgggcacgctgcgcagccgcgtggagggccccggcggcgcaagcgtgctggtggcgctgtacgagagcgggctggtgacggactgcgggcgcggcgagaacaagggcaagtctctgctgaacgaccacgtggtgcggcgcctcgagaaggtggccgccgtgcgggagggcgcctcggcgaagaagaccgtgtccggcaccgtccagttcccgctctgggacggcttccgcgccaccaagtgcggcctcgtgctcttcgtccagaacgccgcgctgcaggtgctcggcgtccagcacttcgacctgcctgacaacgtctgagctggtcacggcggtggccggtggggtgcgtgcgcggcgggcaggcgtgaggcgtgtcattctttgtatgtagcgttcgattggcgtgtgtgctgtatctgtatgtagtacattactggatggtatttggaaggaaacctgagtattcttttttttcccaccgtatttgttatgtactattatggtaatggattttctgttttgtcc

SEQ ID NO: 425 - DNA, 1604 bp, Zea mays
taccaaacgcatgtgtccgggatccgtgtagtcgtagcaacagtttgctaacccattccgcaaatccgcgtttgttccacaagcacatgcacccaaactagtatcgttttcttgcttttgttgtcagttcaatattttctgtaaaaataatgttttgctttgctaattaaaaacgaaaagaaggaaagccttacgcggacggcacgctgctttggctgcaattgtcatcaacgaagaaaaggaaacctgcatgagctatgctgagccgtgacacggcattatctgatccatgcggccattccacatgtgcaagggaacagtgagcctgtttggtaacttatcatattttacctaacttttttaagtttagttttttaattcgaacaactaatctttactaaagtgtagtgtagttagctaccaaccaaaatgatcctgaatccactgattctcagggttcattttgtttttgtctgcaggaaaagaagtaggacattgcttggaagttggaactggccaattgggtgtgtgttgaaaaggggccgaaaatgattgcacaagcagagttttaaacaccatggaagcaacttgttttttatatatatttttaattgtatagttagatatattgtgtacttagatgtataccaacaattacatactttgaaacagagggtgtagttaaatagaccctatttgcaaataaccatttgtgtgtatagatgtgtcattttaccgtagccatgtgtatttagctaatattaggactagtttgggagccacaaaaccagagggaattagaggattcaaaatttccttctatttcaattttgaataaaaaatgattttagctcttctaatcccatcaggttttctagctcccaaactagcccttagattatgtcatttctctttttttctaagaccgtctttgacagtttactcgtatagttacccaaaatactattttatactgttcgtagagtgaaatttggtaaaattagtacaggagaggagtgagggagaaaaagaaaagaaacctaacatctgatgtggagacaaacccctcgccaaacctccattcacggaccacattaacgttagttattattagcctattatagaggaggattacagctcatcattggtgagtggaaaaacgattaggaaagcaggagaaggggagtggcggagtgcatagcaattagcaacatcatccagcggacagcattcctaaccctcctttctatctcacccgtttcttctctgcaagtagtactatttctccgtcatactaaagctctcctgtgtgggcgcgcgcgcgttggaggaaggaggaagtaagcctaggaaagccatcgcccaccttctcgctacccaccaaacgccgcttggtaggagaagaattgcccgaaaagcttcccgttggccgggatctcttcttctttaattacccctggggattgcctggctcattagaccagacagggggagagagggagcgagctggccggctaggccaggagaggagaggggagacacagacaacgagcgctcgctgggaagaggaagaggttcgtggggacgcagggatccagaggaag

SEQ ID NO: 426 - DNA, 595 bp, Zea mays
cctattgtgctggaaccggacaaaaggaaaactgtactttataccggactgcatgctaatgctaatctattaaccgcactccactccaccccctcccgccctgtccacaccaaccacgctcggaggctcccctttcattttcacctcgctccggggccaagtcgccagttcaccaccttcacttcacttcgcaccggaccaccggccgtattcattcctcctccctccctcctcgccatacggctgcagcatcttcccctcaccctcctcattaccccgcgtctctccctcaaaactactcattgctctcaccgttccattgcccccgcggccccgccgtacgctcattcccggctagctcctcctccgcacggccatgatcttgagttcttggcattgatgacgttctagtaccgagcgagccagcccctctttaacccaccttaacaataaacacagcctgcccccaccggccacctcttcttcccccgtgcagctcgagctgattcggcgggctctgccccaacatccacccaccttcgtccaatcccgatccaagaccgtgccgtgatccggcagcagcttccgcgcggcc

SEQ ID NO: 427 - DNA, 795 bp, Zea mays
tttttttttctccatgtaaaagttgaatttcaagtttatatttaaaatcataacttatattgaattttttttacgaatttattattttatatttagttttataccgttaaagttattatattatttaatctttaatctatcaaaataattttaaaaatgataatatatttttgtagtctaagttagggcattaactactgacgaacaaattttgaacaaaaaaattagtttgtacataaagaaataaaaaaagattaatgctcttaagaggtagattgaattaacttaaatgtacatatgggtaaattgaacgaaaaaatagtttagagatttatatgaacaaagtgaggggagtaatttagactttttctagaattgagaaaaaatagcgcattcgaaacgaattttttggtgtgctcctatttccattttcttaaaacggattaaaagaggaagtgttatagttaagccgtgaggaagatttggtgtcaaaatcaaagagtgccatcaaaacctacccaaatttgagccactctgaagcaaaccctcaagtaatttttaacctggactgctttcctgccaaacatgacaactactaatccaacatgagcttatttaactttgcttaattcggccttggcatgctgtcagtccctcccaacctccattccttcctcctttgccaatgcagctctgatctctcctacctgagaatgtcagtgtgagtggccattccatctgcacaacatcctcctccacgcacgcaaaacatacaaaaaggcagaagcggaggag

SEQ ID NO: 428 - DNA, 216 bp, Zea mays
ttataaagagaaaaaatttagataaagtgctctaatatagacagtacgatgatgttattaggtctcatctcacctaataatgttcctgtttgtgggttgggacatcatatcacacctagatccaacaaactgtcatcagcatataatgtttgcacacagccactcaaacatgcatttgcactgcatcgtatatatccaacaaaacggcagctagag

SEQ ID NO: 429 - DNA, 650 bp, Zea mays
tgtgtgcttcaacagttttctatttatttgttgctaatttttaaaattattcgtgtcaacaaaaaagtgagtgagcatgctttatatttttaattgagctagtacatcaacaaccttccataatgttttggaaggtcgaagttgttgatggaagctcagaaggtcgcggcgacggcataaagacaaaacatgacactggagataaatttccgatcaatgggacgatgggacgacacaaaacggtagtcgaaatatggttttcgtgatggatttagaactaacattgatttaggaagtcacaacgaggtttgtaaatgtaaagatgaaattgagttttgtagggagtttataaatttaaggattttctttacataactgttaggggaatagttttcttaaaaaatttcttaaattcatatttagaaaattgtttatataactattggaggtgctcttaggacggagggagtaacaaagataacaatactcttgctctgcttataagctccagctagcagcatatcgtcatgaacaaataagatcagttagcttgtctttatttcttcctccgatcactgattatacacacgcacttgatgaggttagatcgctagttaagcaagaaattagaggaggagagaggggtagcc

SEQ ID NO: 430 - DNA, 1469 bp, Zea mays
tgctatagtagtgcaagctagccgagagaccagttgtacacgcctccacgagtccttccggagcactggatagggcacaggcggtggcagggcgcaaagcttgtgtgtcggctcgcagctatgcctcgacggaaccctggcacatctaatcactccggtctagggacgaaatgaatggaggagaggggagtgacagcttgggtttttattggcacgggataaggggaggttgttatggtccccagtttgagcgaatcatggcagtaggtggttacgacgccggtgcttgcgcccgcgtttaaagaaggggttgaccccccatgtccacccattggtgacacgagaaccgttgtggaggcagcgctgcccagtcgcgtgggcccatgtggcggtggcattgcgcaagaccgcactctctcgtgctggaggcctggcatgcgggccccgcctgttggcacaaagagcccaaggccagcgcgcgaaggaagttggactggggtttgctgggccgaggggggcgaatttaggcccaaagcgaggtctggcttctctttttttcctttttgttttcttttttcttccctatttgaatttctattctcaatttcaaatttgtttgtgagtttcgcacagagttcaagtgcacaagcaaaagtaccagtatcatgaaatattttattttagtttcttatttattaaggaatttatccatgttaacttgtatgtgtgtgtgtgtgtatatatatatatatatacacgctagctaaatgaaagaaagaaattcatgtaatatacattcaaaattctatgtcctttacttactataatttgatattacactcagccatgattttgacataattttaatctggaccacacaacatcggatcttaattttcacatgattattaaatcaaaccagtataaccatcattatattattagattaagctagacgcaaaaacaatgtcagatcaaactagatcaatccagcataaccatcaaaattttagattaatctagaacgtaagcacaacatcaaattattagattaatctcgattgcatagcataaaatcagattatcaaatcagatcaataccgcataatcatcagatttttagattaatccagaataattatcagactaatagattattagattaatccgatgtgcaacatgggattatcaaatcgatctgatataatgaccagatctttcctgtacgcgttggcttacaatgggcttacgaacgcgaagcgcatgatccggggatttgaaagacaagactgcagcgtagacaatatcggcggctagggccttttttttcgtcttgcttcgtgcgtacggcagctagggttccctttttctgtatggccggcggctatgcgcgaatttatatgaggcttttaaagaatagaggagggtacgtagccatggaagagcagcagctccgcgcccgcccaaac

SEQ ID NO: 431 - DNA, 1621 bp, Zea mays
gatcttacaagttactgttcgtgttcgctgtccttggttcttttccggtcaatataatagacttttgcgatgaggaaacgttgcatcgctcatcagtcgtgtgttgggtcaagcatccttctccccgttgggaattgtacaaggaaagatcgaaggcacgcggagctagacaccaaccattgcaggtagcacctactggatagatgggtgtcttgcatgctatccatggcgagggatgggatcgtgatcatgcatttccattgtattcttaaaaacgcaccggcctacaaactagctagctcgcagattcactgaactactgtagggtgaaaaccctgcggcgtcgtcgagcgatttctcaacttggagaaatcggaacgcggtaggaagctacttgacgacagcgacgaacatgcatatgttcattttgcaattgaattgaaatttaattagccagcaagaaagaattatttccttcgtccaaagaattattggcgtgcttggcccccggccccgccgtgaatcatgcattgtctgtgcgatgtttttgattaagccgcgcaacctaactaggaagtaacattggcgggccggcgggcgggcagtatctagaagacctgctttatttccttgctgcgaaaacctagatatggcactgtcaaaatacaggtgaacacattgtttttttcaacaccggggcctgtgcgcaatcaatttttgctttattaagtgggcatgggatatttttcttccgaaaaaaaatgatttccagtcgctagcttgtggaggatatattatctgtggatttcgacacttgacctcactgattttgttcaggttccaaaccatcaagctaagtacgggttaggaccataatgaaccatatgcatcagcacaccttcttcaattgtcagtatgtcagatttgtcatgagtgtagtagctagggcaagatcttccgggggacatgtatgcggagcaagctctttagttcatagtacatgcagtatatattatatatcggggtgatttccgtcatcactacgtaccggggatacaacggtttttttactcgatctgtgtgctcgatctgtgcgtacagtttacctttcagtttccggcaaacttctgcaccgggggaaaaaaaaagaaaaggcacgcggcggcatgcaagatcagcagaattaaactagatcctgcagtgccctgtgcctgtgcgtgcatggtcaaaagagaaggatcgttgccgcatactttggccacactctaaagctagagccctccctccagtgtccagctagctattagctcgagcagctcgcccgccagcccttgatcgttcatctaccggaccaccaaacctttttcgcaagctgcgttcctgtcgaccatgtaagaaaagcctaagaaaatggcggtggtagttgacacgctgctagcgttgctcgccacgccctatatatggagggggggactccggtggctgtccctcccaacacagcacacattattcttcctccacccatctcttgagtcgcctggccggccgccgtcttggttcccctctagagctcaacagcagagcagctgtgtagcatagagcgaggtttaaccatcagcgc

SEQ ID NO: 432 - DNA, 635 bp, Zea mays
ccccgtaaccattatgtactattacttccctacaattttttcacagctgaagcaaccaaaatgtttatcacctaatcttccactacacactcttcattcccacacccttcgcttctcactccaggaaacccacatgtttccagcagtacacgagtgggtgcgcgagtgctctttttcctccccttcctttcgcggcctttgcactccaccggaccaggacacggtcaccacttgaaccgcttccagatctggagccggcatgccactgtgacgcagacacggccgagagggacacccaacccagcggcggcaccaaccgttgcttcacaggcaccaatcataagctggctgggctccgagatgcaccactagcgacacatcacccacccagtgagatcgccaacccaacgcaaacgcatcgaggaatagaagaaggcgaggataaaaagaaaactttcgcaccaccaactcacactgaccgcaacttcccaacaatctcggtccctccctccctcctccctaaactccccagcaacccgcggccgagccccgtagtccgtgcaccagttgtctcgcgtcgtcgtcgtcgccggggctgcagcctgcaggcagcgacctagctaggaacgggtgac

SEQ ID NO: 433 - DNA, 1134 bp, Zea mays
tctgcatatgaagacatcatggttggtttgtgaaagaaacgttgaaagtcctatgttttgtttttggtaattgagtggcaaccagtggactgatcgttgtcataagtgttgaattaggctacgtgatatccaccacaccaagggttcatcagagtgcccaataaaagcgtctagatccctactaggtgggttttagtgatcgaccaatatacaagattattgagacaaacgtttatctttatagaggtgttgtgagttaggtcataataatgatgattgcttgggcaatcaatgagtttcacgccccctatggatggattgtgtttcatttttcaaaggatgggcaactgattttaaatcttatgcaagtgaagacaaatattagaggaatcccactgttgattacttgtagggtcctcgcaagaagcaagctggccaagacggtttagcgaatggccttcaagtacatattgattaacaatgatcttgatcgcgccaaatgttgatggtattcttttgaagttatcggatgaggaccaagcgatagttttatattgattaacaagtgatgatgagcctgagacgagcctgtctcgcaacaactttaatgaactgaactggttcactatcaagcttgcatgcagtgcgccaaccgatcaaccatgacccatgggtctcaactactgcaacattgggccaactccagtagctcgagctcagtcccagtcgacagaccaggactggcagcttcagcgagccgccaaacccccacccactcccggccggaaccgaggtgcatggtgacctgccagcggcagcgccgatatgatcaaacctgccccaccggccggtcgcccgtccccctcgcggccaaccgcgccccgccgggcgccggccgatcccagccctgttccttactaaaccgacggttgccgcgcgcccactccacctcaaaccgtctgcttctgctcaggcacgtccgcgccccacgcccatcggctcccactctctcccaccaactttgaagcactcacttcactcgcgcttgcttcagcttcacccacgccaacgcaggcaagtacgcgaccattcccccctcgccaagcgcgcgggaagaaccaaccaaccagaacc

SEQ ID NO: 434 - DNA, 323 bp, Zea mays
cttcttttatctatagcagaagacaaattaaacccactaaacctgagaccagcaataaagccattaacatagaagaacgtccagcgtactgaagcgtacacatcagaacttttcgattggtcatcagaacttgcgaacaaaatagggtattacattccaaatgtgcagtctaattagtttacctaaccccaactcttctatataagtagtcatatcatggcgccttaattattagaaaacctgaaaacctatcctacaagatacactcttcatccaccccttacgctcagacgtcactagctagccatcatcacacaggcagc

SEQ ID NO: 435 - DNA, 405 bp, Zea mays
gaacgaaattaaatgaccatatgtaaacgaaaaatacgatgcctgctgatcataggcatcatcatttcctcccacctaaatgtacaggccccacattaatctacgtctttcataggacaccgcaccaaactcccaactcgcaatgcacgtatgaagaaccctagcaagatcattgctgtatgcagcttctgctcatgtgctcggacaacgatcccaaccgccgaagctagccacgcagaggagcacgcacccaccactagtataaagccgcgccacctctccgtgtttcgccgcactgcatcagagcacgaccacactacccacccacctccactactgacgaccgattcccagaaagctcgatctagcgcgcgcggctgcagagtgcagacgacgacgtacacc

SEQ ID NO: 436 - DNA, 332 bp, Zea mays
ctttactccatgagcacctgaaaaagtgcacactttgtcctgtctccgctaagctttcatgtagataacattgcgatgtctccacatcatgaactcatggcttctgttccaccaaccaaacgtgttgtcgccttccgtggtgtgttaggacttaggtcgggccggcagaccactcacctatgcgccatggctcgagtgatatgatgtgttaggtaaggcgatggaacccggcaacaaccgccagaaaacagttataaatcaggagcagatcaatcatctcagtacaaggagtcgctggagttaggaggtgcagttatagcagacgcagagca

SEQ ID NO: 437 - DNA, 862 bp, Zea mays
aaattaaaaccattatgaatcacatgtagacctttgggctagtagacagcaaaggtacggaacgtgatgcaaaagcaaatcccaagtcagcgtgtacagtacgggagcactgttcatctatttataggcacgggacgcagcccatgtaaaattacgctcatgccctttacatatgctaatgactctatagtgatccatcgaggtgtaaatagcctttcccgttttaagtcggttttctttcatgctgtcacgctgaaagctcccttgcgcgtagcttggccgctgcatcaaccttcgtatcctttgtgcttctccgactgtggttttgattcgaatccgaaggtacctgttcatgtattacaactccggaaacgttgttaaatcatgtttttaaggacctttagaagacgaaggcccccaacagatcctgaactgcactcattcattcagtcttcctgctctttcgttcatttgtcccgttcattccgttagactggcaagggaaccttttctttcaggtaatcagccacgccaaaaaaaaaacagcctatcactgaccctctcacaagacagcaaatcagcatcattaccaccttgtgatcgtcagaaaaaaagatgagggaactcggaccctctcgtgtctgcacttgctgctgcttgaagcaagcatggctgttaggctgttccacctgggcaggggcagctcacctcacctcaccgtttggtgccctgtaactgtaagactcacccccaccaccttctcttacagctcactcctctccacccacctcgctataagtgccagctagcgtcacgagcccctgccacaccgatcctcccagctgcatctgcattgcattgc

SEQ ID NO: 438 - DNA, 1657 bp, Zea mays
ccactcaagcacagcacgacaggaagccatacatggcgcaacactcccacacagtaccatctaactagctaaagaaggtcgagcgactgaacgcgctataaaaagggctagactccttttcaacttatacttttttggcctgttagctaatataaaatgtgatatgtggacatatgttcatttggtattacattcatttttatgggtatcgaatataattatgtgcatcacaacatatgagcattgtaccggtatctatatatgcacgtgtgtatatatttaacatatatatatatatatatatttatcataattatgaggtgttatcatattgcccggtcctctctaatcaaaagttcaggttccgttactggtgattaacttgggatcgagtgggaatattgacttgtaaattgatagggcagcagcgtaggattttgattgcagtagtcccacctatgtcgatcaagaattgtttgttgttagtgttattggacaagtttgagcacccacgtatgagctgaatgagaccagaaaattgatgtaccttcttaccataatgactaatttgtgagtttaaaacccggaggagattggatggactaaaatcctctctttatttaaaattgaataagaaggagattttagtcccttcaatcttctccggttttgtggtttctaaattagatctaagggtactagctcaatcgtcgctcttaagacgacaaacttattttgtatgaagaaaaaattatgagtagatttatattcataatgtgtttaagatgatattgataccttaccaacgggaagccattgtcgcatttcggagccaaatgagcaataagacgattgactggtcacctacctccagttgcgccgcacacgagagatatcccgtcgccgttggagcatccgttcgtgacggtgacgtggcttgaacatcacgggcctcacggaacggagtctctaatcccagctccggaaagacaccagtgtctgtccctcggataccgatccaacggccggcaggagcgtctgggtgtcggtcatcgccggaagcggcaaaggaacgcccggcagaaccgcattcaagtgcggtccacggtggcgtcggatggcgaagcccagcccacagcccaggactatcctctcaaatgccttgcagaatcttcgaaatgcccccctcaccttatccgtcggcgcgtcgccttttgacgtggtagcccgtcgcctcggccctcggctactatgccctgtgcgagtgcgatctgcgatgcacatggacaagtggaagcagacacaacgttcgtttcagtggcctctgcagatccaggaacgaacccgagaggcaaacagaacagtgaaaagggatggttcagcggggccccggatggcagcctcaaacggcgctgccatcgtccccactcgccaccggtgctcgcctcgtcagtcgccaagaggccagcactgtccagcctggtgtatcaccatgccagacgcacctaccgtccagcgtccgagacgagacctcaccacaccagcctcgcaatccaaaccatagtttaattagccaggctagcagtagcagctgtggtcgtcctcgcttgcttgcttgctaccagggtttgtgtgagtgtgttagtgagagagaacc

SEQ ID NO: 439 - DNA, 667 bp, Zea mays
gctcttcttcgctactactactactcaccaggaaacggacttcggtccgattctaactgggtttcgattcgaaatataataaaaatacaaaaagccaagttctggtaaacagaacgaaaactcggatcaaactcaaaatagcatgcaccgccgaagctgcggcaggaaaaaaaacgttgtggctgccgtagttctgttatttttccccccttcaaaccgaacagcgctggttcttttttttttcctgtggccgtcgtctgttgtggcggcgtgccagggtacgtacggcgtgcgaccaaacacgcccggctgaactgaaactgaaatcatgcgttttgtgacaaatctcatctgattcaactttcattgcaagcataagatctgcattggttggtgtttgacaaatcaaaggaggttgtgttgttactccaggtctccagaccaaccaacgccacgtacaggtacattagagaggcatactagctgagagtccacctcctccactccaatcctccactcatcctaagtttgctaatttgcctctcctcacttcactagttcacttcacctcacttgcgccatcgcccccgccgtcacgacaccacccagccgcaacagtagattacctcgatctctcagagggccagcaaggcggaggaggagagcc

SEQ ID NO: 440 - DNA, 1394 bp, Zea mays
actaagtacatatcaaatgctgcacctgcttcaggagaaaatatttatttaggtacaccgcacacatgacatgatacagcagacctgactttcccttgaaaaaaaaaagagagagaggcaaatttcattagcactttagcattaagagatttacaaaaaaaaaatggacctttaatgtaaatgcaacgagcaaagtgaatttcctgtcccggcatgcatgcagcagcatagcaaccatacttgctactagctagccagtggtgataaagaaaggcaggatgaagctggccaagtaatcccagctcaagaataacagatctacattttcttcagttttgtggtgcgtttttatcaacatagtaccgacgatgatgggttcgttgcactgttgaaaaagctttggaattaaatggaaagattgtggtgacagggatcagagggatgaaattggccgcatatttcacccggagcaacagctactgtacatgaagtcaggtttaagcaatactgtttaggccaagaaggggttcttgaaactgccaaaaagcagagtgatcatgtgatgaagataacttggacaaaactgaccacagaatttggagttcaatgaaaccaacctgaaagccgatcaatgacagagaaaacccggatgaaattggccatgtaatctggagctgcaaacgtaccatgtcgtctatgtttaaaccaccgcctgtttctagtccctaaaataagttaccagccgttgcgagaggtttggacttggctcaggatttctcagccaagtattaccaccggaaaggtgaaactgaaaatgaaaagcaggattggagctatccacatttcgtcaatgtagctagctgtcggagttgtcattagcctgttgtgaactgctggtagcgtagcatagtactgaaattttaaataacacgaaaaactttcatatacaacctacgttaataattaagctatttgctttcttgtgtgtgtagtatagttattaaatacccagctatcccctttcagttaccagaaaggtaattactgacaaggagtagcaggaagagatgagccaagggaactcatgcatgaaccatgtatgtagtgtgctgaaaccaccagcaatttccactcactcactaaactagaaaactaacaccatcgcccatttttttctcaataagatcaagtggaagctttcaagcagctaccttgaagcccatatgctaccaaaccatgccaggacgtaacaccttctgaagctggaagcctttataatagacccacaaccacacaataccaaacctcattccaagctctcttcattggttcatagctagctagttcgcctcccaaaaacacctgccctcgtgcgtggcaggagcacgggcacg

SEQ ID NO: 441 - DNA, 1673 bp, Zea mays
gattatgcaagacatgacggtgagatgacgacgcagctagcatgactgtttgtgggccttaaattcgatttgtccatccggatttctgtaggcctattgctgaacaagaagattcaaggcccagatcaactttatctttatccccgacatgacaatttctaatcaccagactccgcctggtttgggccgggctggtcttcatgcctgagcgtgtttctgctagagaggcctgttgtcataattttaggcccgtaggagcctagcgttcatccatccatacgttttttttcttcttcttttgcgcgagggacatccatccgaccatccgtacttgtagttgtatatatgtacataaataaacttttgagaggataaaactcttcaatgattaggcaacctgatgattaatttcagaacatagatcatgaccaccatatatactagcatgtaaaactctaacatactaattaaaccttacagcatcaatatagacaacaataaaccaaacataattaaataacagaacagatcacgactcatctgcatatgaagacatcatggttggtttgtgaaagaaacgttgaaagtcctatgttttgtttttggtaattgagtggcaaccagtggactgatcgttgtcataagtgttgaattaggctacgtgatatccaccacaccaagggttcatcagagtgcccaataaaagcgtctagatccctactaggtgggttttagtgatcgaccaatatacaagattattgagacaaacgtttatctttatagaggtgttgtgagttaggtcataataatgatgattgcttgggcaatcaatgagtttcacgccccctatggatggattgtgtttcatttttcaaaggatgggcaactgattttaaatcttatgcaagtgaagacaaatattagaggaatcccactgttgattacttgtagggtcctcgcaagaagcaagctggccaagacggtttagcgaatggccttcaagtacatattgattaacaatgatcttgatcgcgccaaatgttgatggtattcttttgaagttatcggatgaggaccaagcgatagttttatattgattaacaagtgatgatgagcctgagacgagcctgtctcgcaacaactttaatgaactgaactggttcactatcaagcttgcatgcagtgcgccaaccgatcaaccatgacccatgggtctcaactactgcaacattgggccaactccagtagctcgagctcagtcccagtcgacagaccaggactggcagcttcagcgagccgccaaacccccacccactcccggccggaaccgaggtgcatggtgacctgccagcggcagcgccgatatgatcaaacctgccccaccggccggtcgcccgtccccctcgcggccaaccgcgccccgccgggcgccggccgatcccagccctgttccttactaaaccgacggttgccgcgcgcccactccacctcaaaccgtctgcttctgctcaggcacgtccgcgccccacgcccatcggctcccactctctcccaccaactttgaagcactcacttcactcgcgcttgcttcagcttcacccacgccaacgcaggcaagtacgcgaccattcccccctcgccaagcgcgcgggaagaaccaaccaaccagaacc

SEQ ID NO: 442 - DNA, 642 bp, Zea mays
cgttttaaatacattagggtaggatacaggatgagctaatatccgtccgtatccgaccgttttcacccctaggcgtgggttacgcggtccctttcccgtcacgtcggcgcatccgcccgcggtgcctgccaatgcgatcctgaggctggcaggctgcccgcgccagtggaagcagtggacggctaggcttcagctcccgcggattccacgtgcgcccgcggccgcgcgcactgtcggtggcgtcccgtgggccgtggccttgcagtgacacgcggggacaatggatgggagcaaaggctggcatgtagtacgggacactgaaaccaaccaaggggcggcacggcatcggaaggtaccctacggatggacccggacacgacacgacacgtcttgtgcaccgtaaaaagcatcagaggacacgtcgtcggacctgtttgccggcactgacccctgttgggtcgagttcgttggtgcccaacatattccccggcgtcggcgtgggggcagggccagaccacccctgccctgagtggccgctctcatctgatctcctctttctagctagctcgtccgccgtcgatccatacatgttgctcgcaggaacacctgaaagaagatgccgcaccgcaccacaccacacac

SEQ ID NO: 443 - DNA, 662 bp, Zea mays
tttctaaactgttttatcctcataaattagaacagaaaggaaaaaataatatcttgcaaatcagatcatgcgataatttcattgatttgtttgattagtataaatactcgcggttgcggcaggcggacaacaggaacacgccaaatccgtgttggctgtgacggcatatgtgcatgatcggtcggtttctggacgagtactcatcacagcgagaaaagccgaaacggtaggcgtcccctgccgtgcgatgcaccgtttctcgcgaatattcatgtgccacatgacgccggctttcgccatttcggtcgcgctttccactagccgatccgatgccggccccgtacgtacgacagcacggcacgcgccaaaactgaccctgtatcatgccatccgggccggccacgacttgtatccacaacgacagccacgctgcacccgccccgccccgcccccgcggtccaccagccgccatgttccctccctcttattttcggttggttgcctcgtcgtctcgtccctatatatccacacggacgcagcccgcgcctttgtgccctccggagcgcacggcggcggcctcctgccgaccttcgcggtagcaagctagcagctagctagccgcagttagcgtctctttcgtccgtcctcctgcgccggccgtc

SEQ ID NO: 444 - DNA, 3376 bp, Zea mays
ctctagctaggtttctgtccgttgaaatccaagggacgacgacggacgatatcggatcaggcatatatagccttccatagcttttgatggtacatagagctcgatcatcacaagcaacggaaaccaacaaccgtagtacgtagtagtatatatacatgacgatatgagctctagatagctaatgattgcattacgctaactagtagcgactaaccgccactgcatgcgcaacaccactgaccacactgtgtcatgaaattaagagggttagacacgacgacagagacctatagatggccatttggcactaacacgatgggccagcccagacacggcacaaaaaagcacggtccaggcacgacccggtccggttagtatagtgccagtgcctggcacgacacagctatagtgccgtgcctgggccactatctcgacccgtagtgctggcacaggcacgacacggttacattttttattttaaaaataatagtttacatatattaagtataagaattcaacatataatacaataaaactgcagctgcactggttagatggatgcgtttaagcctcttatatgcactaggttgtgggttcgagccctcacaactacacatgttttgctaaattctacaatatactcagatgggccatagtgccaccgggccggcccggcacgactaataggctcacggaccgtgcctgggccgtggcagcggcatgccggcccatctgggcacggcacgcttcgtagccgggcctggcgggccgtgccagcgtcgggccgtgccggcacggcccgtttggccatctatacagagacctgaggagaagcaaggggaaaaaaaatggctacacgtgactaaagtttagtccctaacatgtttggttgtagggactaaaattagtaatattatactaaatgactaataagaagactaaaatggcttttaatattcttttgctattagtacaattgaactaaacgaggagcaaatgtggaattaatatggtttagtctcttttagccatatcttgaggaactagggactaaatcaatttagtctctgttttagtcttactgtttagcaatttagtaactaaatgtgactaaaatggatggactaatttttagtcgtatgccttggagaggattatattttgcatgcacgcatgcggtctttgcccttctccttctggatggctacctagatagccgtgacatgacggttcctgggtctgggtcgcatcgcatgcatcaccctagctagctactagtatagctagtacaaagtgcttgcatgcaagtagctagcagctagctagtaggccgccgggagtatctgtatatatagcaagtaaggccccgtttcaatctcacgggataaactttagcttcatgctaaactttagctatatgaattgaagtgctaaagtttagtttcaattaccaccattagctctcctgtttagattacaaatggctaaaagtagctaaaaaaagctgctaaagtttatctcgcgagattgaaacagggcctaagtatggatggaatggaacggatacgacaaagctagctcgctgttgatgagcgctggatcggagctaagctaacgctctggttggatatacttacttgttggatgtattcgccgaaatgggaaacctgccaagtgcttggattgtgcaggcacggtggcacgtgcagtgggcatcttactgtattggatcatgttagatgcatgcatgcctgccatgttgcgagctgattgttcacaggcattcgacggcgaacacctagaattcagtcatacaccatatgaacttcgacaaaatgacaccagcggccacggtagcaagctagcaaagcaacataggaaccaattatatatatttgacgagttctaatggcggatgatgtcgattttgtgatccaaattctgaagaagacggctaaattgacgagcgaagcggaggctcccccgtcttcgggaggcttatcttttttttcctaataagattttattatattattactttgtgtgtgcatgcatgtgcactgtatatatatgtcatttgtactttgatgcgagtgacaccaacagctggtccatccatatgggagaagaagaagaagctagtgccacacatatgcattgatcagctctgtaccaggctagctagctgcttcttatgtatgcaggcagatagtagccaggggtagtaattataattattatatgaagcagccagagaagaggacacaaataaaataatagagacgagatgggatggatatatatatatatatatatatatataaagaacacgaatattagaccaccatcctcaaaagattccaaggctaggcgtgtcaatatctatagttaagttgtgtgtgtgtgtatatatataaattctactaattccttatatatacacagacatatgtatatgatactatgtacgtaggtacgtgtatatatatgggtacgtccgtacgagagcaatataacgcatggagcaagagaaatggaaaaccgttggctttgtcctctccctttctctctcttaatttctactgctcgtagtacgtactagcaaggatgcagtgcagcacctttcctctgtctctctctctctctctctctctctctcctgcgtctctctcaggagtgggtggcaaaactaacccccactgctactagcagctaggagctctgcagcagggctagctagcctgcagtgcactgaccgacgactcttatctactagaagatgtggtcgtaccagtattgtattgtgtagagagagagagaaagagctagcagccagcagcagcagcagatacgtacaggtacaacaagcagagctatctaggtaggtagcaacagagagagagagagagtgaagcaggcagaggcagcagcatggaaatggaatggtggccatatgattcatggatgatgggtgcatggtggacgcgatcgaatcgaacgcgatcccctcccccctcaccccctaatttcactcggatccatgcctgtgtgtgctagctgccgtcgtcggccttgcctcgcaaaagtacccccaaccccccactatatataagtgcagcgcctttcctcccctgccaccaccagcttccctcctagctcttctctttcctcatcatcgtcttcctcccctcacatcctctggcctctggtcctccaccgtcctgctagccagagctgctcttgtacgcgcagctggcctctgtgcatatcaccagcacaccgcgcaggggaaggaaattaacaagagaaaaggcaaggagagcaggcaggcaaggaagctgcagaagccaaggaaggagaaggaggatcatcaatg

SEQ ID NO: 445 - DNA, 1002 bp, Zea mays
cacccttccttcgtttgtcttctcatcctatttctttctcacgacgatttggcctgctgtaccgaagcacttgttttcagtctactggatggaaggatcagacacaatggaaacatgtttgctttagacaaatctttattcctttgttcctcaaccgtgttttttaacccatcacaaattattgaatgctgaactgatttgtattaggcgatcaggctacactaatgttctctaatgaaaagggtgttgccaatacggatcatcttaacagacaacacatcgaagaagatatggctgaacaggtgggtcgtttaactcatgaaacagaggcttcaaatgagtaagtaataatgcaaatcagatttatctttcctcgatgagcgcattttaattggtcgccgtcctcccaagagttcatccaactggagcgcacgaatttccgcgcgattgagttcatccagataacggccgcgcggcaatccgctggaattcttccgtcggtccagtcctcctaacccaaccgcaagaagcagcggcccccgcccactcctcacctcacctaacccgcccggtggtaaaggcaagatctcaccggccgcgcggtaccagccgccgcccagatttcgccaataaaatgctcagctccactgacgaaagcttgccggtatcgtcctgcccacgcgacgcgagagcgggagcggtgggtcgagtgacgagctggaccccgccgctagtcccctacccctgcctgctcccccccgcctgccccgtgtttatatctgccgcgccgcacagggagagagtcgagtccagctcggcaggtcagtcagtagtggatagctccgctcgcggtcgcgggcggctcgagtcgcaccccagatcccaatgcgccccgccgcgccgcactaggccgcggaacggaagctaggtgcgtcacacgccggggccggtcgcggtcaccggaccggacgcacaggggcgccgtacgtgcagtcatcggcc

SEQ ID NO: 446 - DNA, 512 bp, Zea mays
gcggcgctcgatataacatgccatggcgttcaatctccgttcctttagggcttgtttgggacaaagagtaatggaggggattgagggggctataatccctcactattaaaaattaagtagtagaggattctagccccctcaatccactccattacctttgattccaaacaagcccttagggatgagccgccgagacagctacccaccagcgcactaagccgtgcgagctagcgcgccgttactgggcggcgagctccgcgggagggtgccacgccgcgggagggtgcgcgccagtgctcgctccaccgatgctctctcgactcctgccatcatgaggtcggtcgctgctagccacgcttgcacgctccacgccactatataagtcgcagcgcagcggccatgaagccacacaagtcatccgagaagcaagcacaagcactgcaccgaacgagcagcgagcgtgttgaggcaggcagtcagtggcagtgggagtaggagacaaggctaccgag

SEQ ID NO: 447 - DNA, 623 bp, Zea mays
gcccctagtaattgcacaaaaaaagatgcatttaaaaggaatcgaacttgagacctccagtctagaatgccttggagctgctgcagcaaccaatcaagcctgattgttttagtgacgttaatgcacccatatccctatttaataggggcaaacagggaaaactctatgataattaatcactccttggtatgcacaatcatgtcctaaacgactacctttactgcactggagggagtacttgtttttaccctaaaaccttgtgtacactatcagttaagccaatatgtccccttcgattttttgtcagactccgacgctgctcgtagcaaggaacaactaataaacgagaaaaacgaagaggctttgccatacagaagggccgccttgttgaggcagagctagagaacggagcagcgagtggcccagcgacaagttttccaattcgcttccaccaactaggccaaccaccaccgtgctgtgaccccctaccatgcaggccacgaacccggcggccatcatggcgcctatatagaacccagcactcattccatagcaaagtgcaccacttcacttgcttcaaagcgcaaacacacaagaagggcggagctgttgtcatcctgaca

SEQ ID NO: 448 - DNA, 3653 bp, Zea mays
gaggcatcagctacctgcaaacctacaccgaacaggagcttggtttctgggtagaggtactgttatacttagagtgaaagaaaagacaatcacgcacaattatcacattttcctggaaagtgaaaggaaaccaagaagctagtgcgtgtttttttcggaaccaaaaggtaaagttgaaaaaactgctaggtaggtgtagtcaaaggagggcattaccttcttgctgcactttctattcctatagattttgtgatatacaagctaaaaaaatcagggttggtctaactagagatggccaaacgggccgtccggcccagctcggtgaagcccggtccgttttgggcccggcccgccagacacggttagaaaaccgggccgggctgtctaagcccgcaggcttgatttcctgtccgagcccggcccatttagcacgaaaaaagtgggacaaaaagcggaccggtaagcacgttttagtgcaaaaaaaagcgggcttagaggtaaacgggccgtgcggggctagcccaccgtgcctagtttcatgtccgacccgcttattcgtgtcgggccagtccgggcccgcatagaaccggaccgggcccaaacaacgggcttcgtgccgggttcacgggcctcgtgcttattggtcatctataggtctaacaaatggcatggaaccaatatacaaatgtgtagttataaaaaaacatctgtactttccttttttttcttaccagacttagctatattactaatgttgccattatatttaactatcttaagataatttaaaataactccacatttgtcattacaaaataatacaccatatgtcccaaaatatagttttttagcccactttttttctatcaacattcattcaaatgataataaatatagacatatatgcaaactacattcatatattacttaataaatgcgtaactagtctgaaacaaattatattttgaaacagatgaagcataaagtatctttagttattttataaattatccacctttatcgttactaaagataatgcatagtaacctctcaagtttgtattcaacttactcatatatatcgttatgtctataaatgtataaaacagtaaggaatactcgtatcttctaaagttctaatccgtgcgagagcagggattgatgatgagttaaatggactagtacagttgaacatggcagccagcaccaaaaatgaatttccctctccctttgatgattaaggcgtctattaatgtgagctcgttgatacctatcgctgaacaatcattattctgctagacttggtgcatatggaagatgctcaatcgatcccgccagatataaaactgtatcaactgtgtcaagtggctgtctcaccgacacttcaaaatcaggtcaggtaatgagctcacgttatgaaatccagctgacacctcatatcgccgaattatataacgaccgcgacatatttatttctgaaacaataaaatgttatacgtacatagacgtgcacagcttatatttcatttaagaataacaagtatctgtgagtccttcaattctaatcaagagctaaccgaccattccaagaaagatcatttttttttcacgagataaaaaggtagctgatgacaatttgtgacattatctcgtagtcatgtgcttgtctactttaagaaaaatagtttggtattggtactttgagtgtcatgcaagctgaaggaatttttgatatagaaaaagtcaaaaaaggacattggttacattgtgaggatcactaaccgcaccgatggactgagctggctctggcttgaagccttccgtgaatagccttcgtaaccacttactgactcttgtagctgtactgtacatgtggtctagactcctgatcagagagcgaaaagaaaaggagtggttcaaaattaccggagtttctttagtttgcgctcaaacggtcagatgaaatcttgatacctatcctaagacgattctaatctgtgcattagtttttggcagagtaggagtctttgtgcttagaagttagagtgagcacactgtcacttctgataacattgtaatcctgttttttccctgtgacatttttctaacagagatgtagtataggccagttagtctaacagatctcgatgtcagacaacgaataaacaagtttattactggtggccttgcgcaggacgagttcaaaagcgcagagtgcgctgctggactcggaaagtcagaagcacttcatagttcatacagccgggtgacagtttgcaattgaccttccaataaaactgagattgcggtatcctattggtcagatggtacacaatcccaacagaattatcagaaaagcaagcagtgcatgattccagaaaaacacccacacccacacacacaaagatcgggcctgtaatacagacagtagtttctgaaacggggtctgaatccgtaatgagtgggatctacttctgaaacggggtctaatcgtcctactaccactaatggagcagtgcaatttactcaagaacgacggatcagaaacgcccaggacagcaggcaggagaaaagcgcggccagctgagctgatacctggccagctttcagcagtcggcacgcaccttcttcgctgagagcgcgcgggcacctaccgcttccccattttcgccgagggagcccgcagcagcagctgccacccatacgaacatctcagcattttttttgtttaatttttaatgtttcttctcccgcccgacacgaaagaacgccgcggttttatatactacgccccctcttcatagcgctccttcgagttcgagctgccaccgtctctccttcctccgtcccctcttccctgctctgctccatcaggtttgcttctcctccctcggatttcctcttcttctcctgcattttgcaacgcaattgacagcttgagagttaccgactctctctctctctctacatgcattgtggtgcactgatgcttgtgtaacttgtcgccgtgttgctacatctcgggaacatgagagtttttatgtcatctagcacatggtggtggtagttcttcagctttaagtcgaagcgaagaccctgtaggctagaacatgagagagtgctcgtctaggtagctgtattttttagtaaaggatctaggcggttggttggttcttttcacttttagtgttggcttgagatctgaaagttcctctcttttttttctttctttgcccccttttttaaaataagctagcagattcaatgatccatctagcttgtatccgaattaattgacactttttcccccctagtgacagcgagtgaatcggttaccaaaatgtaataatacatgctcctgagtaatagatcagtaatgacacgattccaattaaatactattgatctgaacgcacaaatatcagcataaatttttagatactttgatcaagagaaacgaactatatgtttttttacaacgagacacaaccaccaaacttttcccttttaattatgaagaactctcagccttgatcgatcaaccagatcaaatcggctaactacatatacttcgtgcgtgatctcgtcagggcaggggcttgcatcagagaaggtagtagagaggatcaggtgcgcgagacagacgctgcaatg

SEQ ID NO: 449 - DNA, 1623 bp, Zea mays
cagctgagtctaacttggaggagacttacaactcgctaatgtatgtgcttctttcttcactgagtcttatgttccctcgtctcttggatttgctatttgtcactgtttccatctatgtggttttgatatattagctttcccatcgacgaccatttcaattgttcgtatcaaatgggtatgatggttaggttaatttcgtttctactgattggaatctatttttttggaagtttgtatgaatatatgacattcctgtggtatggtgcagtggctttgtttatactctctgtcctaaaatatagttctttctaacctacttttttttgtccacgttcattcaaatgataatgaatctagacatacatggaaactacattcatatgttatttaatgaatatgtgattagtctaaaacgaattatattttgggacgggaggtagtataatttttgaaaccctgtaggtatgcttcacgggttcgttgcattgttaatgatacgagcaagcatgttgccccaaaagaaatcatgaggttgaagaagttgatcgcctactggaaggagcaagcaggcaagcggagtgatgaggacgaactagaggagatacaggaagagaggatctcaaaagagagatcagacaatcgcatgactagctgacgatgctcctggtttcattcttccattacctggtgaagaggtgattgatgccgatgagcatttgtgactgccacgagttctgcgatcgctctctaacagaatgttcctatatcatctgacggccctgtaagtgtacactaattgtatagtagctacgtattatttctatggcggcggcgatgcccagcctgcttgtacaaagaggaatgtagcacatacattgatagaaggggaaaaagttgattatcgcttctttgctgacgagagattggcgatgtgttgctctatgccttggcgtcataccataaagaaaccttccaaagtcagatgagttggccttcacatgggcagaatacagtggtctgtgcaactaacatcaagttgacctacatttccagaaataatgttaattatacaataagcagcacaaaaataagattcctcagtcgcacgaaagcacgcaatcactttcctgtgttggttggtagattgtcacggcaagaacaccgaattcacatattttcttaaggaattgggcgcgataagaaaaaaagtgaaaacaaatacaactctagcataaaaaatcacattaaagactaaaaaataatataaaaaacaatatttatgatgctcattaaattttatatgatgctttaaattttatatacttggactagatagagctggacgtgcaaacctgctacgcgaaaatagttacatcacacgacgtgtgagtgtgactgcccgctctcctatctcgtcctcaccaactcttcgactatttctctcttctattgcttttataataataactatagattgcagctgcagcagttcaaacagcttcaaacagctgtatttattaatctgaagccaagttttaaatttgttttaactcacgaacccaccacatcacagagggcaagccggcgaagtttgaagagcgacggccgacgactgaagcaata

SEQ ID NO: 450 - DNA, 3185 bp, Zea mays
ttgataagttatacatccaggatgtcctctccatcaccacctgtaaaaaagtaacataaacacacaagaaccaacctttcttagcaacattcttccaaaaaataaagataaaccccccccttgtattttgtgaaatctggccctctaatggaagttgggctgcgagctatagttcttgtcgggaaggatgaaggggtgaaaccctatatccaaaatgtggctaaatttaaggaaaatgaacaaaaattggcaagaggaacataaaaccaaactttcctagccatgctcttctctctaacacatggtgaaggcctagttccaaaattgagcaaagatgaacaataattggcaattaaaacataattaaaccaactttcatagcaactaataaaaacaatcttaattaccaaacctatcttcttctctctctccacacaacacatgaaccattcattaaacaacttaatatgtcatggataaactgatttgagaactaaacatgaaaaaggagagaggatagacaaaatctaaccatattaaacaactttatttgagcgaatagagcaaaaatgtggctaaaatgtggctaaaattgagagaggatacactctctctcaaatggtgaaaccctagatccaaaatgtggctaaaattgagcaaaaatgaataaaaattgacattagcaacataaaccaacctttcttagcaatcttcttccaaaaaatgaagatcaaaacctctccccatgtattttgtgaattctggacctccaaaatcgcctccaatggaagttggctgcgagcatacagttcactgtcgggggaagaagaggggtatttataacagacacttcactggcggttgtctttaaaaaccgccagtgaaaattgatttccactggcggttgtctttaaaaaccgccagtgaaaataggatgtttccactggcggttaagttatgataaccgccagtggaaatcaattttcactgacggtttgtgttacacaaccgccagtggaaacatcctatttccactggcggttgtgttaagataaccgccagtggaaataggtttccactggcggtttttaaagccgggcccacctgtttctttcactgacgtttgataacggaaaccgacagtgaaaagttgaacgtgccgcaggctttgagcttatttgtactagtgcaccgcccataggcacgggtcgtgtttgggccagcctaattccatgaagtctataatgtttaatttttttaatttagtaagttgtgaactttatgtagatgtaatgtttagactttatgttgttcaaatatgtggtccggacgtggaccgacaggctcgatgacggatcagcgtgttttaggggttgagctgagccacaatttctgcactttagattgtcacaacacgacctaaatttttttggccttctcaacccaagcctatttgccccaagcacaatgggcccgatctggctcaattctcagcactactaggcaggactatcccgagaagaatattctcagttgatgatgtcccaaatatccctcaaaattgggcagccaagtccttccatagaggacgaggctcctcacatcccacgcatgcgtatttatacctcacatctccatagcattcctcaaaggatgtgatcaatccatctctacttatccaaccaaacaaaaaacaacaatcatcctatccctccaatcaagcaatagggatcatttccattaagttgcacgcaataaataattcaacctaaaaacttaagcttataaaaggaggacaattcacttatatttcaacacccccttatgtcgaatcttatttaggtctttgatgtggaatatgagcaaacaacaattattttagtttaattgtgttagccaggattcgaactcgtgacatctagctttgataacatattaaggggtatttagtttctagagactaaattttagtccctctattttaatccattttagtccctcggaaactaaaatagagttttagttgagttttagtttctgtatatggtaatttagtgactaaaatagaataaaatgaagggactaaaaattagcctatagataccaaacaccctttaaattatatgcaacaactaattcatcccaaaagcctaaacttatagaaggagaaaggcaatccacatatattatatttcaacaatttcatctcttaaaccagagttcatcctatgtctaattagtctgtttataaaaattagattcccagtttcttaaaaaacaagaagccaccttctagctaaaatataaaaactaatttcttaaaaactgccttgcttccaaacaggaccaaagttatatacatcaactaattcaatccaaaaacttaaacttatagaaggagaaggacaattcagttacggggcgtttggatccctttattttaatgaaattggaattcactcaataaagtaacttatttagtttggaatttggcatttcaccactttccaaagttcagatataagactatatcaaattcatagagtggatgataggaaatgattttatacattattagaatttgtttctactatgtaacttacatgacactcttcgttccactcctctatagtaaaaatgtagcacataaatatctccgacatcttgttaataataatatataaatatattttgcataaaagtgaattagcttaattgatatatgcctaaattactattattaaaatggaattcaatgatgcaaacgggacgttattatattccaacaatttcatctcttaaaccagagttcatctcttaaaccagagtcccacaaccaaacatatgcttaagctccaatccactgcactctctctctctctctgtctctctgctcggcttgcttcaaacccacttgatcgttgcgtcgtctcccggggcccgggccgacccttagccagctccccgtacgtgcgcagttctcggcacgctaccccatatatccccccagccgctctccacagatagagacgcacacgggcagtgacacgcgcgcataccgacggacttggtagctgctcaccagctatccagatcattggctcattgctgcttccattccattcccccttccctcggcatcggccgcgcccgcccgtgtcgggcggaggcggacgcgcgcggga

SEQ ID NO: 451 - DNA, 3060 bp, Zea mays
tgatagaatatagatctatgtttagttttctattactgatctatcaggtaatgatctctctttgcaaccactcccgctgctgcgtcggcggtgcacgcaggagctttcctgagccaaccgtctctctctaccgccacctctgaaaaagcttttgcttagtagtgttttggtgatctaattctttaccaggagcaatgattaattgacgatgggttaaaaataggtggaagtggaacagaccttaactcaagcggtccttgtcgtcgacaagcgctgctgtatctgtatgtattctgattggcgaatcggaagcagtgttttctgattctgatggtgaaagcgtcctcttgggcctcattttgtggaaagatgggaaagaaacgggccgcagctccgagaacagaaggcgtgtagcccagcaaagcatggtttggttctcttcaagctctgggactggctctctcctcctctcttttttcaatggccaggaaaaagaaaagtagcgtaagctcaagggggggctctccatgcacctgatctcattgcaatctgcatcgctgataggtcacccttggaaatgtcatgcatgccctatctctgcatatatatatggtttggtgaggagctgtcgagttgacaggcagagatgacacagctccttttttcttctttcttttctttttgcctggccttaaggcttgagtgacatactccttgcctggtagcctcgcagttgcaggtagtcggtctcctctggtcttgtccatcttctgacatgagagcgcatctaattccatgatattgttcatttcttgcattgatcgtctaatgtcctacatattgatctgtaattaggactaaacaacatgcatggttggtggcggtggttgaagctggcacaacatgctacatttcttgctaggttggccccgtgtggtgtggtgtggtggactccacttgcactgtcaccgcaatggactgcagcatcccgatagatagatatatagaatgtattcactcactccataaaaagtacagattataatcaatctaataatattcattttgtatcatatatattagtgttcttttatatgaatttgaatttatttggttttgttgcttttttttgtgtgtgtggagcatacaggagtcagccgacaggaacagtgttactcagacatgcttactctagctagatgttgctcttctaccttccctgctaaagtgctgtatgaattgcaggcacaaccctgcatgcagagtttgaggcaggcaggcaggtaaggttgatccgtcgtcgtccataaaagtgcattccaatccgcgctgcagcgaacgaatatcataattgctagtgtctgctggtgaaccaaatcagagcttccctctgtgtttatattatatatgccagcattcagttcattttaccgtctaacatggcaatcacaacgccaaccttccaactaatacgtgccttgcactcttaaacacggactgctgctatgcttggacttgtgcaggaagccaagcggaccaccattcggttgcaactactgctacagatcttaccagccttgtaaggctcaaccaaatcagctggctggtgtacattccagtaataatggtacccattctcttctctttctctgctgctcactgttcatgtttttttttcagacggagtatggttggacaaagccgctccgctttcaatttgttgttgtttagattaattccacgtaggacagagtgactataaaaaaaagaaagattatgcttaaatactgaaccatccgactccctaaaatcttccaaacagagccgctccatccgaagtagctctggaaccaaacactaccttattctcattggagccatgcatttcttgctatgcttagagaaggaataatgcagaaaaggggcctatggtttagcactgagtctgagtaggtcatttttaagataccaaaccaaactaaagatagaatgtgttagtttatggtgttacctcaacgtttctcagcagattttcttcaaaggtcgtatctcaattatttgtgttgatgcactgataggccaatatgatgggcccctttgatgcctgaagtgtgcacacatgtggcttgtgcaaaatatgtagctttccagtgcatccttaaaagaataagagagagagtaactatgtagcttacaatagaatgctcaatttactcttaagtacatgcatagataggccaaaactgatcatggcaaattcccctttttgatatattcatgccacacacatagacacaaacacaaacacaaaaggaacacaaaccgtactggttccgaagggagaaggggaccatgagaaacctaaattatccactaatgcactgtgtctaattccttcttaagaattcgacgaatgttctgattttcagggaaacaaagtgctgacattggtttactagagcacggccagaaacagaggattatggttgagctggattttcgaacattagtggtctttgcattcaagagctcagtagcttaatcatcattcattcgaggcaagaatgctgctgtgctggccaccagcccatcacctttccgttgcttcagatgcactctggtcttttttcagtagtcagtggtgtccaagtcatttgtttattggcatgctacagtcgtatctataaataatggttggtgcgtgtgtgtgtggattggtatagccgtcggtgacagaaacaaccacttctacaaattctaaagttttttttttttggttagcacttctactacactgccctcttttttctggttagcgcgagggtcagtgttctaggttgcttgggtagcactactttttcctagagctggggcatgcatataaccatgtgcaggagcagtgttgctagcagcattggatttgccccagtgtactacagactcgacaggtacggtgagcataaaagaggagagccgataagcacaatggcgcctgaggaaaggatgaagcagacagagggcagtcacaaggtggtaacagcagcagcagcaggtggcaag

SEQ ID NO: 452 - DNA, 519 bp, Zea mays
taatttccctctcccctagcaatgccggctacaatgagaccccccccacggcgcgcatcgtttgcccctacagagtcccttagcgagcagagcgcttctctctcccttcactcctggcgtgttactgttcacgcgccctaacactgtttggtactatagctatgggcccacgatgaattgttagtacataaaaagttaatagtgaataaaaagtatttataaaaatgatattttatggttgtattggagtatagaggaagtatttaggggggaccggtgcgagagataaaaaaagtagggaataaaatgttgatgatgtgacacaaaaaatatataggagaaaaaatttagaagaaaccgctgcggatagccttagcccttagtctagcacggttgcacccaacccaaactaccaaaccccctcccttcttctcttcttggtccccgcgcgcgcacttgcatcattgcatgcagcacacctgaacaacttgcctgttgtactgtaccacgagcagccac

SEQ ID NO: 453 - DNA, 5214 bp, Zea mays
agtgttggctatatgtcagctgtattagttctacagggatgggatctatttgtggacaaggactaatataccagcagtcattagatgcaagcgtgcaagcagctctcttggtccattggatctaaatccaaccgtatgtgtaattatggtttgttaggagtttttttataaaactaaacgagatggtgttggaaggatttaaatgctaaatatagtatacggttagatctagatctaacggaccaaaagacatgcttgcacgcttgtatataatagctcctgcttgtatattagtcgttgcctatataattctagtttctagtagcaaatgaggtgttactggattgattattactgtgtacgcggaggggggacagaagattaccgcgtgtagccctgagagaccgagacatttgagattagagagttttcagaaagaaaatgttctggcccagtaggctcagctttgtggtcgcaattttatccatttgggccacgaagtaatggcccagtggcctcaggtaacgtaaaatgggcctaattcagacaacctatgcgcacagaaatcgacgcgcctaaacaaatcctgctgcctttttttttaaaaaggaaatcctatattaaaacattatctagcttataaaagaataaaaaatcagagatttaggattagtcctcagcgacatgaaagcaggcactaaggtgctggagagaagacatatacgtactccaagaaacagaggggtgtttggtttgaggtggtgaactgatgatggattcaactcatttctttccataaaccaaacaaaaaagtaagatgtgagaagatgatagactagcttattactcaaaccaaacaccctataaaaatttgagtaaaatatctgaatgagttcagacaagagcatgacagccaatctacaccaaaacaatactagttattatcagctgaaggaagatcctcgttcgctttaattttcctaaataaagtaaaccgtggtactgccaaaggatgaagtaaaaggcaggtggtgtggtgtgtgccgaaacctgaaaattttcagttctgggtggcggacccatggcgagtgatcgcccggtgtcccagtcgccacgcggcgactagcgacaccgcttcacttgtactctagacgtcgagagcagcgggcccaccacgtacgtcatcgtcaggtgccgtcgacggtgaacggtggtggcacccgcgtctcgctcgccaccgcacccgacgaccggccggccggccggcagcgaaagggagcaaaaagtcgtcaggggaactcgtgaggctgcgatcacgattggtcatgccggcggggcgcccaggcgaacgcgaagccgtcgaggccacggcgctggtgggctgcaacggaaggcaacccctgacctacggacgtcggtttctaatcagccggcggagcagcttttgcgggcggggagaagggcacggccacacggggatggcgtgatcgaccgatcgtctacgacgggacctgcgagctgatgcgatggttggtgtgtatggaagggaagtcatgtagagtcaccgctcgacggcgatccttggttcccgtccaggcggtaatgatatactgtattttctgtcgacccgcgtacttgcgttggcttcagcctcgaagtaacagactaacaggcaaccagaaatggcatccaggttgtgccgtcaatattcagaatctgagtttgggccagcgcacgcactcgcacgaaccacgaacatggtttccaaactggcaggatttgcaaaaaaaaaaaaaccaagtcgggatacaaactggaaactgctaggatttgcaaaaaaataaaataaaaatctcttttgagtgagggctgagcgcgtttggctgtggggtcgtcggtacaggcacaagaaaagagtgagaccgaaggttcaccaacgggctagctgttgggccattgcctttgcttgcatccacaggaacaccccccctccccctccctccatgctttacctacaaccgccaactcaggtcactcaaggggctttgatgctctcgatctacatgtacattggacgcgccgccggctgagatgaaagatcattttcgcagccgtccttgcctccgatccactggtaaaagtgaccggaaagaaaatacgctagctccggtggcgtggttttggtttgctccagcagaagctaaggaaccaagactgatggcaataggtgaccaaaaaacaagctaattaagtgaccgccatgccagatcagggcaagatataataaaaaaaaccggattattattacagtcttgggtcttcttggcacaccatgcgaatttcctcccacaaatggtctaatggggttatcacattcacaactcgaaggtttggttcacgggctagaactcggcggtgctgcactgcaccacgcacctctgcgaattcgtctttccggcaccaactccctcactgttggtggggactcttcgtcactgttcccagcatcgttttctatgctggtggtggcccaatgaatgcaaggccggccgggtaatctagaacaccttgctggtcggcaggcactcgtgtacaatacaccagtagcagcaacaacaacaacacatgctcgcatgctgcacgatgccttgtaggctcgccaaggaagcatccactgaccagcatccaagcgaggcagcctgaccgcccaccgtactacacgcgagcgcgcgcttctgcccccgccctgtaaaactctgaacataaaagtgcatcgccctgcctccctctcttcatctccctcttccaaggagaacacccacctctctctctctctctctctctctctctctctctctcttgttgggacctggagaagaggaaggaacagggagcaggggggaagaagaggttgctgcgacggctcaagcctcaagtaagcaccagttcattcatagtgtcgtctgaccttcatctatttctgttgtttgcttcccacttccccatgtctaatgtcggtactagctagatcatgtcttcgttctacgccttttgaatcttgacaatgtactaattcatagacctgctgacaagcctgctgcgcattatcaaggtacacgtatgacgtatacccttgtgcccggctagattcagagaagcagtcgttaccgttatagaagtgtgtacttgtatcgacagtgtactgcgtatgctcgctgttttgtactgctagaatctgaagccacacgaacagcatagcatagtgcactactgcactatgctatgcgtgacaacttgttgatctctctctctctctctaagatttatgtccatggtcttgcttattaattaattacctggtccggtaggctattagcatgtgtcttcgttgatcccacgtggacaaaaatgcgcacaaaagcaacaaatcaaggaataatgtcatcagggttagcgcagatgacattaacgactctggtcatcgtttagggctactctgagaacttcaaatccccttcgggatcggaggggattggggtgtaaatgaactaatttttagtttccaaactatggctattatttcagctagaaaaagtttatatagcttgtgatgattttcatgaattagttgagtagggctgtctaccccatgcctttacgacaatgctggctacgagtatgttagatgcaactagcctttcagcccgtacatctgcatcaaacatgagctccctgctttaggcttttctcagttatatatatatatatatatatatatatatatataaaacacatattttttaatgaaaaagacaagtcgattcaaattcgcgtcaatttacagaaggaaataagaatctaaagagagcagagtcctctgcaacggaggtcggtgcattgggattttccatccatttccactacagcaaaaaaagggggggtcaccttccacaaatttccttctcaaccacttggatctcaccaaccatgcaaagctacttcttaagcaacatattaatatattataataagagaccaccaaacacatgaagcgtgcggtgggttggataaccactataagaacatgcatgtgttcagttcctcttgtcttcctgtcatcttatgagccacttttttgtttgcttataatcttgtgaatcatttgaaagcaactgtaaccaccttcggtttgttgtgcatctgagggcccagtaggtagtaggctccagttctccaaaatataggacaagactatggctggctactgactttttaagaagttagctcgggtacaatgtacaaccatgtgttaggataaaagcaagcaatatgcatgtgcaatcataccaactttgcaattgatgatcttgagagttgagagctgaccgatttaatcaatatctctgttactttaaagcatcagtgtcgtgtgtcgtgtatcacgtacgaaacgtataggtctgttcctcttctccactacttgcctaacaatagaccgttatatcatgtatggaccttgagaaactactcaagcccataaaccctaaactctaagccacacgtggtacatcgctcacacatagtaccacctcgctagccgaaggacgacgagcgatctattaaaaaaatgagttaggctcctttaacctcatacttttttcggcattttagttaagataaattgtaatatttattcttattagtttagtatctgatatgttgatcatatgtttcctctaatattaaatttaccttttattttatgggtattaaatatgattgtgtgtcgcaatacacagatattgtaatagtatgaatatataggtcatggttagccttgtttggtgtgagcatattacatgcggcaggtaaagtgccaggcaatatacaacgaaaagcatcaacgtgtttatgggttccggcaacaagcgcgctacaggcaatgctaactaccgcctggcccgttctgtggtccagtgagttagggcatcaatggttcaatactactaattaatttataatcacaaatggacagcatcacactgacaaaacactatggttgtacaacagcaatgagttcaagccaaacatgccaaggaacgaactagatatgccttctattttctcaagtttagtatgcatccttagatcgactatactctttacagatttttggatccaggcagacaagcagagaaacaccagttggtcaag

SEQ ID NO: 454 - DNA, 356 bp, Zea mays
ttatggagaatataaagagtctccgtaatataaagagtctcttgtagtgctcaatgctctaataaagctatatacctatagaaagagaacccatatagaaaatgaaaccgatgaagtactaattattatcaataatattaggaagacaatgctgagttaggcgagatatttgcaatgtgagcacgatttaactgggacccacttcaatttgattagagagcttaacggcattccgcccccacttcctccacctcatgagtgcaacctccgtggacgaagcattcgcctcgccttgatctccaaccccttccttccttgcttaggagagagagggaggagaggagaggaggaagaag

SEQ ID NO: 455 - DNA, 3060 bp, Zea mays; identical to SEQ ID NO: 451

SEQ ID NO: 456 - DNA, 2248 bp, Zea mays
gaatttgattgaaacatttagaactgcaatatcttttttaaactcctctaatcagagaattgctgcatataaaagttattgcattgctactaatattaggcctagaaaattccagttggacatggaggttaggtggaactctacatatctcatgcttaagcatttgtttcctcataagatacctttcactactttcatgcatgcaaactatcctagggctgaaggtgatcaatttattttaactgatgaacattgggttgttggagagaaagtacttaaatttcttgagctattttatgattctacagttgcattgtctggtgtttattatcccacatctccacttatgcttcattttcttgttaagattgctatacatctaaagaactatgctaatgacactcacatcagaggtgtcattcaacctatgatagataaatataataaatattggaggaacatccctttactttactcttttgcattcatcttggaccctagagctaaaatgaaaggttttagtagagtgcttagaagattaatgaacctgacaagtacagattatgctgtttatcaggttaccactagagctaagcttactgatgtttataataaatatgaagagaaatatggatctgttagattgaacagggttgtccctcctaacttgtctggtaagaaacggtctgcttgggatgaaatttatgatgatgctgatgatgtgggtacttctgttggtatgcattcttttgcttctactctaaacattgctagagatacctctgcaactgctctactgcatgctgcaagctcttcagcttctactgcttctgaactcatttcttacttagattgtgacactgtcaaccaattaactgatgatttcaatatcttgcactggtggcatcagcacaaactcacttatccagtactgtcaattatggctaaagatattttaactgttcctgtgtctaccatctcttcagaatccacttttagtttaactggcaggatcatcgacgagcggaggaggagattgaagtctgatgtggttgagatgttgacatgcattaaagattgggaggatgctcaagcaaggatgcaacacatggtggatgacaaagagcttgaagaaacatttgaagatctttatcttgattagtcttactctctttctgaccatttctgtaatgggactgtaatattatgcacctggacactggactggactgtaaacatttgaaaaacattttaatgagctgggctgtactcttttttcctgtctagggtttctcacaagggtgagttttacctatacaggtttttaacgaggcaaccattgcactacagctcataaaattgttgtttgattagtctcttactctctttgtgaatgctgtttgaatactgtttgaatctgttattaactatgaaatctgttactcagttatgctgtttgaatgctgctgctggtttttctactcgtagtgcccgtgctggcactagcactggcgtgctggcgtgcctgttggcacggcacgacacggttaagcactggtagtgccgtgcctgggccgagggcccagcacgctggcactaataggcacggcacggatcttctaccgtgcctaaccgtgccgtgtcctttcgtgccgtgcctagccgtgctagtgccagtgccgtgccgtgcggcccggttggccatctataaagcaaagcatcatcatgcatcgtgaaagcaaaaggcgtgctcctcctctttacatttggtaaagaacacgaccacaaaatgtatactagtagcagtcatggagtatattgcatctcagatcgcactgaaccagtggaaactaaatgtagcaaaagtcagcagcaggaaaagatagatgaaaaaaaaacaaagagggctgcctggaggttaggcgtgggcgcgtaacacacacatggcagctagccggcgacgatccaagagcgggtgcgtggcgacaggctggtaccctgttgccgtcgcctccgccatgttacgttccaccacctctcctctccactccacccacccaacagctgcccccaccaatcacatcacaccagacacctcctacttatcttgcgcgccaagggccagcgcgcgagcgacctcacttgatccgctcccttcgccgcgacgacgttcctacgcagctgcggtcgacgcgcgcacggcagctcgctcgctagctgatcacgacagctcgctcggctcgaccga

What is claimed is:

1. A recombinant expression cassette, comprising an isolated polynucleotide selected from the group consisting of:
   a. a polynucleotide having at least 96% identity, as determined by the GAP algorithm under default parameters, to the full length sequence of a polynucleotide consisting of SEQ ID NO:1, wherein the polynucleotide encodes a polypeptide that functions as a modifier of secondary cell wall development;
   b. a polynucleotide encoding a polypeptide consisting of SEQ ID NO:2; and
   c. a polynucleotide consisting of SEQ ID NO: 1; and
   d. a polynucleotide which is fully complementary to the polynucleotide of (a), (b) or (c),
   wherein the polynucleotide is operably linked, in sense or anti-sense orientation, to a promoter.

2. A host cell comprising the expression cassette of claim 1.

3. A transgenic plant comprising the recombinant expression cassette of claim 1.

4. The transgenic plant of claim 3, wherein said plant is a monocot.

5. The transgenic plant of claim 3, wherein said plant is a dicot.

6. The transgenic plant of claim 3, wherein said plant is selected from the group consisting of: maize, soybean, sunflower, sorghum, canola, wheat, alfalfa, cotton, rice, barley, millet, peanut and cocoa.

7. A transgenic seed from the transgenic plant of claim 3.

8. A method of modulating secondary cell wall development in plants, comprising:
   a. introducing into a plant cell a recombinant expression cassette comprising the polynucleotide of claim 1 operably linked to a promoter; and
   b. culturing the plant under plant cell growing conditions; wherein the secondary cell wall development in said plant cell is modulated.

9. The method of claim 8, wherein the plant cell is from a plant selected from the group consisting of: maize, soybean, sunflower, sorghum, canola, wheat, alfalfa, cotton, rice, barley, millet, peanut and cocoa.

10. A method of modulating the whole plant or secondary cell wall development in a plant, comprising:
    a. introducing into a plant cell a recombinant expression cassette comprising the polynucleotide of claim 1 operably linked to a promoter;
    b. culturing the plant cell under plant cell growing conditions; and
    c. regenerating a plant form said plant cell; wherein the secondary cell wall development in said plant is modulated.

11. The method of claim 10, wherein the plant is selected from the group consisting of: maize, soybean, sorghum, canola, wheat, alfalfa, cotton, rice, barley, millet, peanut, and cocoa.

12. A product derived from the method of processing of transgenic plant tissues from a transgenic plant expressing an isolated polynucleotide encoding an SWC gene, the method comprising:
    a. transforming a plant cell with a recombinant expression cassette comprising a polynucleotide having at least 95% sequence identity to the full length sequence of a polynucleotide consisting of SEQ ID NO:1 operably linked to a promoter; and
    b. culturing the transformed plant cell under plant cell growing conditions; wherein the growth in said transformed plant is modulated;
    c. growing the plant cell under plant-forming conditions to express the polynucleotide in the plant tissue; and
    d. processing the plant tissue to obtain a product,
    wherein said product comprises the expression cassette of claim 1.

13. The product according to claim 12, wherein the polynucleotide further encodes a polypeptide consisting of SEQ ID NO: 2.

14. The transgenic plant of claim 12, wherein the plant is a monocot.

15. The transgenic plant of claim 12, wherein the plant is selected from the group consisting of: maize, soybean, sunflower, sorghum, canola, wheat, alfalfa, cotton, rice, barley, and millet.

16. The product according to claim 12, which improves stalk strength of a plant by overexpression of the polynucleotide.

17. The product according to claim 12, which increases yield by increasing biomass.

18. The method of claim 8, where said plant has improved canopy shape.

19. The method of claim 8, where said plant has increased photosynthetic capacity in leaf tissue.

20. The method of claim 8, where said plant has improved stalk strength.

21. The method of claim 8, where said plant has improved plant standibility.

22. The method of claim 8, where said plant has altered vascular bundle structure or number.

23. The method of claim 8, where said plant has increased root biomass.

24. The method of claim 8, where said plant has enhanced root growth.

25. The method of claim 8, where said plant has modulated shoot development.

26. The method of claim 8, where said plant has modulated leaf development.

27. The method of claim 8, where said plant has improved silage quality and digestibility.

* * * * *